United States Patent 11,596,699 (RNA ENCODING AN ANTIBODY) - sequence listing, part 6

SEQ ID NO: 31196 - RNA, 1341 nt, Artificial Sequence
  derived and/or modified sequence opt4 from Olizuab_HeavyChain1
gaggugcagcugguggagagcggcggcggccuggugcagcccggcggcagccugagacugagcugcgccgugagcggcuacagcaucaccagcggcuacagcuggaacuggaucagacaggcccccggcaagggccuggaguggguggccagcaucaccuacgacggcagcaccaacuacaaccccagcgugaagggcagaaucaccaucagcagagacgacagcaagaacaccuucuaccugcagaacagccugagagccgaggacaccgccguguacuacugcgccagaggcagccacuacuucggccacuggcacuucgccguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggcaag

SEQ ID NO: 31197 - RNA, 651 nt, Artificial Sequence
  derived and/or modified sequence opt4 from Olizuab_LightChain1
gacauccagcugacccagagccccagcagccugagcgccagcgugggcgacagagugaccaucaccugcagagccagccagagcguggacuacgacggcgacagcuacaacugguaccagcagaagcccggcaaggcccccaagcugcugaucuacgccgccagcuaccuggagagcggcgugcccagcagauucagcggcagcggcagcggcaccgacuucacccugaccaucagcagccugcagcccgaggacuucgccaccuacuacugccagcagagccacgaggaccccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31198 - RNA, 1341 nt, Artificial Sequence
  derived and/or modified sequence opt4 from Olokizumab_HeavyChain1
gaggugcagcugguggagagcggcggcggccuggugcagcccggcggcagccugagacugagcugcgccgccagcggcuucaacuucaacgacuacuucaugaacugggugagacaggcccccggcaagggccuggaguggguggcccagaugagaaacaagaacuaccaguacggcaccuacuacgccgagagccuggagggcagauucaccaucagcagagacgacagcaagaacagccuguaccugcagaugaacagccugaagaccgaggacaccgccguguacuacugcgccagagagagcuacuacggcuucaccagcuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31199 - RNA, 642 nt, Artificial Sequence
  derived and/or modified sequence opt4 from Olokizumab_LightChain1
gacauccagaugacccagagccccagcagccugagcgccagcgugggcgacagagugaccaucaccugccaggccagccaggacaucggcaucagccugagcugguaccagcagaagcccggcaaggcccccaagcugcugaucuacaacgccaacaaccuggccgacggcgugcccagcagauucagcggcagcggcagcggcaccgacuucacccugaccaucagcagccugcagcccgaggacuucgccaccuacuacugccugcagcacaacagcgcccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31200 - RNA, 1341 nt, Artificial Sequence
  derived and/or modified sequence opt4 from Omalizumab_HeavyChain
gaggugcagcugguggagagcggcggcggccuggugcagcccggcggcagccugagacugagcugcgccgugagcggcuacagcaucaccagcggcuacagcuggaacuggaucagacaggcccccggcaagggccuggaguggguggccagcaucaccuacgacggcagcaccaacuacgccgacagcgugaagggcagauucaccaucagcagagacgacagcaagaacaccuucuaccugcagaugaacagccugagagccgaggacaccgccguguacuacugcgccagaggcagccacuacuucggccacuggcacuucgccguguggggccagggcacccuggugaccgugagcagcggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggccgagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31201 - RNA, 645 nt, Artificial Sequence
  derived and/or modified sequence opt4 from Omalizumab_LightChain
gacauccagcugacccagagccccagcagccugagcgccagcgugggcgacagagugaccaucaccugcagagccagccagagcguggacuacgacggcgacagcuacaugaacugguaccagcagaagcccggcaaggcccccaagcugcugaucuacgccgccagcuaccuggagagcggcgugcccagcagauucagcggcagcggcagcggcaccgacuucacccugaccaucagcagccugcagcccgaggacuucgccaccuacuacugccagcagagccacgaggaccccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacaga

SEQ ID NO: 31202 - RNA, 1347 nt, Artificial Sequence
  derived and/or modified sequence opt4 from Onartuzumab_HeavyChain1
gaggugcagcugguggagagcggcggcggccuggugcagcccggcggcagccugagacugagcugcgccgccagcggcuacaccuucaccagcuacuggcugcacugggugagacaggcccccggcaagggccuggagugggugggcaugaucgaccccagcaacagcgacaccagauucaaccccaacuucaaggacagauucaccaucagcgccgacaccagcaagaacaccgccuaccugcagaugaacagccugagagccgaggacaccgccguguacuacugcgccaccuacagaagcuacgugaccccccuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugagcugcgccgugaagggcuucuaccccagcgacaucgccguggagugggagagcaacggccagcccgagaacaacuacaagaccaccccccccgugcuggacagcgacggcagcuucuuccuggugagcaagcugaccguggacaagagcagauggcagcagggcaacguguucagcugcagcgugaugcacgaggcccugcacaaccacuacacccagaagagccugagccugagccccggcaag

SEQ ID NO: 31203 - RNA, 681 nt, Artificial Sequence
  derived and/or modified sequence opt4 from Onartuzumab_HeavyChain2
gacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccuguggugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31204 - RNA, 660 nt, Artificial Sequence
  derived and/or modified sequence opt4 from Onartuzumab_LightChain1
gacauccagaugacccagagccccagcagccugagcgccagcgugggcgacagagugaccaucaccugcaagagcagccagagccugcuguacaccagcagccagaagaacuaccuggccugguaccagcagaagcccggcaaggcccccaagcugcugaucuacugggccagcaccagagagagcggcgugcccagcagauucagcggcagcggcagcggcaccgacuucacccugaccaucagcagccugcagcccgaggacuucgccaccuacuacugccagcaguacuacgccuaccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31205 - RNA, 1362 nt, Artificial Sequence
  derived and/or modified sequence opt4 from Ontuxizumab_HeavyChain1
caggugcagcugcaggagagcggccccggccuggugagacccagccagacccugagccugaccugcaccgccagcggcuacaccuucaccgacuacgugauccacugggugaagcagccccccggcagaggccuggaguggaucggcuacaucaaccccuacgacgacgacaccaccuacaaccagaaguucaagggcagagugaccaugcugguggacaccagcagcaacaccgccuaccugagacugagcagcgugaccgccgaggacaccgccguguacuacugcgccagaagaggcaacagcuacgacggcuacuucgacuacagcauggacuacuggggcagcggcacccccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcuucuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31206 - RNA, 645 nt, Artificial Sequence
  derived and/or modified sequence opt4 from Ontuxizumab_LightChain1
gacauccagaugacccagagccccagcagccugagcgccagcgugggcgacagagugaccaucaccugcagagccagccagaacgugggcaccgccguggccuggcugcagcagacccccggcaaggcccccaagcugcugaucuacagcgccagcaacagauacaccggcgugcccagcagauucagcggcagcggcagcggcaccgacuacaccuucaccaucagcagccugcagcccgaggacaucgccaccuacuacugccagcaguacaccaacuaccccauguacaccuucggccagggcaccaaggugcagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31207 - RNA, 1341 nt, Artificial Sequence
  derived and/or modified sequence opt4 from Opicinumab_HeavyChain1
gaggugcagcugcuggagagcggcggcggccuggugcagcccggcggcagccugagacugagcugcgccgccagcggcuucaccuucagcgccuacgagaugaagugggugagacaggcccccggcaagggccuggagugggugagcgugaucggccccagcggcggcuucaccuucuacgccgacagcgugaagggcagauucaccaucagcagagacaacagcaagaacacccuguaccugcagaugaacagccugagagccgaggacaccgccguguacuacugcgccaccgagggcgacaacgacgccuucgacaucuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcgccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31208 - RNA, 645 nt, Artificial Sequence
  derived and/or modified sequence opt4 from Opicinumab_LightChain1
gacauccagaugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccauguacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31209 - RNA, 1941 nt, Artificial Sequence
  derived and/or modified sequence opt4 from Oportuzumab_monatox_HeavyChain1
caccaccaccaccaccacgacauccagaugacccagagccccagcagccugagcgccagcgugggcgacagagugaccaucaccugcagaagcaccaagagccugcugcacagcaacggcaucaccuaccuguacugguaccagcagaagcccggcaaggcccccaagcugcugaucuaccagaugagcaaccuggccagcggcgugcccagcagauucagcagcagcggcagcggcaccgacuucacccugaccaucagcagccugcagcccgaggacuucgccaccuacuacugcgcccagaaccuggagauccccagaaccuucggccagggcaccaagguggagcugaagagagccacccccagccacaacagccaccaggugcccagcgccggcggccccaccgccaacagcggcaccagcggcagcgaggugcagcuggugcagagcggccccggccuggugcagcccggcggcagcgugagaaucagcugcgccgccagcggcuacaccuucaccaacuacggcaugaacugggugaagcaggcccccggcaagggccuggaguggaugggcuggaucaacaccuacaccggcgagagcaccuacgccgacagcuucaagggcagauucaccuucagccuggacaccagcgccagcgccgccuaccugcagaucaacagccugagagccgaggacaccgccguguacuacugcgccagauucgccaucaagggcgacuacuggggccagggcacccugcugaccgugagcagcgaguucggcggcgcccccgaguuccccaagcccagcaccccccccggcagcagcggccuggagggcggcagccuggccgcccugaccgcccaccaggccugccaccugccccuggagaccuucaccagacacagacagcccagaggcugggagcagcuggagcagugcggcuaccccgugcagagacugguggcccuguaccuggccgccagacugagcuggaaccagguggaccaggugaucagaaacgcccuggccagccccggcagcggcggcgaccugggcgaggccaucagagagcagcccgagcaggccagacuggcccugacccuggccgccgccgagagcgagagauucgugagacagggcaccggcaacgacgaggccggcgccgccagcgccgacguggugagccugaccugccccguggccgccggcgagugcgccggccccgccgacagcggcgacgcccugcuggagagaaacuaccccaccggcgccgaguuccugggcgacggcggcgacgugagcuucagcaccagaggcacccagaacuggaccguggagagacugcugcaggcccacagacagcuggaggagagaggcuacguguucgugggcuaccacggcaccuuccuggaggccgcccagagcaucguguucggcggcgugagagccagaagccaggaccuggacgccaucuggagaggcuucuacaucgccggcgaccccgcccuggccuacggcuacgcccaggaccaggagcccgacgccagaggcagaaucagaaacggcgcccugcugagaguguacgugcccagaagcagccugcccggcuucuacagaaccggccugacccuggccgcccccgaggccgccggcgagguggagagacugaucggccacccccugccccugagacuggacgccaucaccggccccgaggaggagggcggcagacuggagaccauccugggcuggccccuggccgagagaaccguggugauccccagcgccauccccaccgaccccagaaacgugggcggcgaccuggaccccagcagcauccccgacaaggagcaggccaucagcgcccugcccgacuacgccagccagcccggcaagcccccccaccaccaccaccaccacaaggacgagcug

SEQ ID NO: 31210 - RNA, 1941 nt, Artificial Sequence; identical to SEQ ID NO: 31209
  derived and/or modified sequence opt4 from Oportuzumab_monatox_SingleChain_variable_fragment

SEQ ID NO: 31211 - RNA, 762 nt, Artificial Sequence
  derived and/or modified sequence opt4 from Oreptacog_alfa_HeavyChain1
aucgugggcggcaaggugugccccaagggcgagugccccuggcaggugcugcugcuggugaacggcgcccagcugugcggcggcacccugaucaacaccaucuggguggugagcgccgcccacugcuucgacaagaucaagaacuggagaaaccugaucgccgugcugggcgagcacgaccugagcgagcacgacggcgacgagcagagcagaagaguggcccaggugaucauccccagcaccuacgugcccggcaccaccaaccacgacaucgcccugcugagacugcaccagcccgugaaccugaccgaccacguggugccccugugccugcccgagagaaccuucagcgagagaacccuggccuucgugagauucagccuggugagcggcuggggccagcugcuggacagaggcgccaccgcccuggagcugauggugcugaacgugcccagacugaugacccaggacugccugcagcagagcagaaaggugggcgacagccccaacaucaccgaguacauguucugcgccggcuacagcgacggcagcaaggacagcugcaagggcgacagcggcggcccccacgccacccacuacagaggcaccugguaccugaccggcaucgugagcuggggccagggcugcgccaccgugggccacuucggcguguacaccagagugagccaguacaucgaguggcugcagaagcugaugagaagcgagcccagacccggcgugcugcugagagcccccuucccc

SEQ ID NO: 31212 - RNA, 456 nt, Artificial Sequence
  derived and/or modified sequence opt4 from Oreptacog_alfa_LightChain1
gccaacgccuuccuggaggagcugagacagggcagccuggagagagagugcaaggaggagcagugcagcuucgaggaggccagagagaucuucgaggacgaggaggagaccaagcuguucuggaucagcuacagcgacggcgaccagugcgccagcagccccugccagaacggcggcagcugcaaggaccagcugcagagcuacaucugcuucugccugcccgccuucgagggcagaaacugcgagacccacaaggacgaccagcugaucugcgugaacgagaacggcggcugcgagcaguacugcagcgaccacaacggcaccaagagaagcugcagaugccacgagggcuacagccugcuggccgacggcgugagcugcacccccaccguggaguaccccugcggcaagauccccauccuggagaagagaaacgccagcaagccccagggcaga

SEQ ID NO: 31213 - RNA, 1353 nt, Artificial Sequence
  derived and/or modified sequence opt4 from Orticumab_HeavyChain1
gaggugcagcugcuggagagcggcggcggccuggugcagcccggcggcagccugagacugagcugcgccgccagcggcuucaccuucagcaacgccuggaugagcugggugagacaggcccccggcaagggccuggagugggugagcagcaucagcgugggcggccacagaaccuacuacgccgacagcgugaagggcagaagcaccaucagcagagacaacagcaagaacacccuguaccugcagaugaacagccugagagccgaggacaccgccguguacuacugcgccagaaucagagugggccccagcggcggcgccuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31214 - RNA, 648 nt, Artificial Sequence
  derived and/or modified sequence opt4 from Orticumab_LightChain1
cagagcgugcugacccagccccccagcgccagcggcacccccggccagagagugaccaucagcugcagcggcagcaacaccaacaucggcaagaacuacgugagcugguaccagcagcugcccggcaccgcccccaagcugcugaucuacgccaacagcaacagacccagcggcgugcccgacagauucagcggcagcaagagcggcaccagcgccagccuggccaucagcggccugagaagcgaggacgaggccgacuacuacugcgccagcugggacgccagccugaacggcuggguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31215 - RNA, 1347 nt, Artificial Sequence
  derived and/or modified sequence opt4 from Otelixizumab_HeavyChain1
gaggugcagcugcuggagagcggcggcggccuggugcagcccggcggcagccugagacugagcugcgccgccagcggcuucaccuucagcagcuuccccauggccugggugagacaggcccccggcaagggccuggagugggugagcaccaucagcaccagcggcggcagaaccuacuacagagacagcgugaagggcagauucaccaucagcagagacaacagcaagaacacccuguaccugcagaugaacagccugagagccgaggacaccgccguguacuacugcgccaaguucagacaguacagcggcggcuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31216 - RNA, 648 nt, Artificial Sequence
  derived and/or modified sequence opt4 from Otelixizumab_LightChain1
gacauccagcugacccagcccaacagcgugagcaccagccugggcagcaccgugaagcugagcugcacccugagcagcggcaacaucgagaacaacuacgugcacugguaccagcuguacgagggcagaagccccaccaccaugaucuacgacgacgacaagagacccgacggcgugcccgacagauucagcggcagcaucgacagaagcagcaacagcgccuuccugaccauccacaacguggccaucgaggacgaggccaucuacuucugccacagcuacgugagcagcuucaacguguucggcggcggcaccaagcugaccgugcugagacagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31217 - RNA, 1449 nt, Artificial Sequence
  derived and/or modified sequence opt4 from Otlertuzumab_HeavyChain1
gaggugcagcuggugcagagcggcgccgaggugaagaagcccggcgagagccugaagaucagcugcaagggcagcggcuacagcuucaccggcuacaacaugaacugggugagacagaugcccggcaagggccuggaguggaugggcaacaucgaccccuacuacggcggcaccaccuacaacagaaaguucaagggccaggugaccaucagcgccgacaagagcaucagcaccgccuaccugcaguggagcagccugaaggccagcgacaccgccauguacuacugcgccagaagcgugggccccuucgacagcuggggccagggcacccuggugaccgugagcagcggcggcggcggcagcggcggcggcggcagcggcggcggcggcagcggcggcggcggcagcggcggcggcggcagcgagaucgugcugacccagagccccgccacccugagccugagccccggcgagagagccacccugagcugcagagccagcgagaacguguacagcuaccuggccugguaccagcagaagcccggccaggcccccagacugcugaucuacuucgccaagacccuggccgagggcauccccgccagauucagcggcagcggcagcggcaccgacuucacccugaccaucagcagccuggagcccgaggacuucgccguguacuacugccagcaccacagcgacaaccccuggaccuucggccagggcaccaagguggagaucaagggcgaccaggagcccaagagcagcgacaagacccacaccagcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31218 - RNA, 1347 nt, Artificial Sequence
  derived and/or modified sequence opt4 from Oxelumab_HeavyChain1
gaggugcagcugcuggagagcggcggcggccuggugcagcccggcggcagccugagacugagcugcgccgccagcggcuucaccuucaacagcuacgccaugagcugggugagacaggcccccggcaagggccuggagugggugagcaucaucagcggcagcggcggcuucaccuacuacgccgacagcgugaagggcagauucaccaucagcagagacaacagcagaaccacccuguaccugcagaugaacagccugagagccgaggacaccgccguguacuacugcgccaaggacagacugguggcccccggcaccuucgacuacuggggccagggcgcccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31219 - RNA, 642 nt, Artificial Sequence
  derived and/or modified sequence opt4 from Oxelumab_LightChain1
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuaccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31220 - RNA, 1329 nt, Artificial Sequence
  derived and/or modified sequence opt4 from Ozanezumab_HeavyChain1
caggugcagcuggugcagagcggcgccgaggugaagaagcccggcgccagcgugaaggugagcugcaaggccagcggcuacaccuucaccagcuacuggaugcacugggugagacaggcccccggccagggccuggaguggaucggcaacaucaaccccagcaacggcggcaccaacuacaacgagaaguucaagagcaaggccaccaugaccagagacaccagcaccagcaccgccuacauggagcugagcagccugagaagcgaggacaccgccguguacuacugcgagcugaugcagggcuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcuggccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31221 - RNA, 657 nt, Artificial Sequence
  derived and/or modified sequence opt4 from Ozanezumab_LightChain1
gacaucgugaugacccagagcccccugagcaaccccgugacccugggccagcccgugagcaucagcugcagaagcagcaagagccugcuguacaaggacggcaagaccuaccugaacugguuccugcagagacccggccagagcccccagcugcugaucuaccugaugagcaccagagccagcggcgugcccgacagauucagcggcggcggcagcggcaccgacuucacccugaagaucagcagaguggaggccgaggacgugggcguguacuacugccagcagcugguggaguacccccugaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31222 - RNA, 1089 nt, Artificial Sequence
  derived and/or modified sequence opt4 from Ozoralizumab_HeavyChain1
gaggugcagcugguggagagcggcggcggccuggugcagcccggcggcagccugagacugagcugcgccgccagcggcuucaccuucagcgacuacuggauguacugggugagacaggcccccggcaagggccuggagugggugagcgagaucaacaccaacggccugaucaccaaguaccccgacagcgugaagggcagauucaccaucagcagagacaacgccaagaacacccuguaccugcagaugaacagccugagacccgaggacaccgccguguacuacugcgccagaagccccagcggcuucaacagaggccagggcacccuggugaccgugagcagcggcggcggcggcagcggcggcggcagcgaggugcagcugguggagagcggcggcggccuggugcagcccggcaacagccugagacugagcugcgccgccagcggcuucaccuucagcagcuucggcaugagcugggugagacaggcccccggcaagggccuggagugggugagcagcaucagcggcagcggcagcgacacccuguacgccgacagcgugaagggcagauucaccaucagcagagacaacgccaagaccacccuguaccugcagaugaacagccugagacccgaggacaccgccguguacuacugcaccaucggcggcagccugagcagaagcagccagggcacccuggugaccgugagcagcggcggcggcggcagcggcggcggcagcgaggugcagcugguggagagcggcggcggccuggugcagcccggcggcagccugagacugagcugcgccgccagcggcuucaccuucagcgacuacuggauguacugggugagacaggcccccggcaagggccuggagugggugagcgagaucaacaccaacggccugaucaccaaguaccccgacagcgugaagggcagauucaccaucagcagagacaacgccaagaacacccuguaccugcagaugaacagccugagacccgaggacaccgccguguacuacugcgccagaagccccagcggcuucaacagaggccagggcacccuggugaccgugagcagc

SEQ ID NO: 31223 - RNA, 1350 nt, Artificial Sequence
  derived and/or modified sequence opt4 from Palivizumab_HeavyChain
caggugacccugagagagagcggccccgcccuggugaagcccacccagacccugacccugaccugcaccuucagcggcuucagccugagcaccagcggcaugagcgugggcuggaucagacagccccccggcaaggcccuggaguggcuggccgacaucuggugggacgacaagaaggacuacaaccccagccugaagagcagacugaccaucagcaaggacaccagcaagaaccagguggugcugaaggugaccaacauggaccccgccgacaccgccaccuacuacugcgccagaagcaugaucaccaacugguacuucgacguguggggcgccggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31224 - RNA, 639 nt, Artificial Sequence
  derived and/or modified sequence opt4 from Palivizumab_LightChain
gacauccagaugacccagagccccagcacccugagcgccagcgugggcgacagagugaccaucaccugcaagugccagcugagcgugggcuacaugcacugguaccagcagaagcccggcaaggcccccaagcugcugaucuacgacaccagcaagcuggccagcggcgugcccagcagauucagcggcagcggcagcggcaccgaguucacccugaccaucagcagccugcagcccgacgacuucgccaccuacuacugcuuccagggcagcggcuaccccuucaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31225 - RNA, 360 nt, Artificial Sequence
  derived and/or modified sequence opt4 from Palivizumab_VH-Region
caggugacccugagagagagcggccccgcccuggugaagcccacccagacccugacccugaccugcaccuucagcggcuucagccugagcaccagcggcaugagcgugggcuggaucagacagccccccggcaaggcccuggaguggcuggccgacaucuggugggacgacaagaaggacuacaaccccagccugaagagcagacugaccaucagcaaggacaccagcaagaaccagguggugcugaaggugaccaacauggaccccgccgacaccgccaccuacuacugcgccagaagcaugaucaccaacugguacuucgacguguggggcgccggcaccaccgugaccgugagcagc

SEQ ID NO: 31226 - RNA, 1347 nt, Artificial Sequence; identical to SEQ ID NO: 30862
  derived and/or modified sequence opt4 from Pamrevlumab_HeavyChain1

SEQ ID NO: 31227 - RNA, 642 nt, Artificial Sequence; identical to SEQ ID NO: 30863
  derived and/or modified sequence opt4 from Pamrevlumab_LightChain1

SEQ ID NO: 31228 - RNA, 1305 nt, Artificial Sequence
  derived and/or modified sequence opt4 from Panitumumab_HeavyChain1
caggugcagcugcaggagagcggccccggccuggugaagcccagcgagacccugagccugaccugcaccgugagcggcggcagcgugagcagcggcgacuacuacuggaccuggaucagacagagccccggcaagggccuggaguggaucggccacaucuacuacagcggcaacaccaacuacaaccccagccugaagagcagacugaccaucagcaucgacaccagcaagacccaguucagccugaagcugagcagcgugaccgccgccgacaccgccaucuacuacugcgugagagacagagugaccggcgccuucgacaucuggggccagggcaccauggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacgagagaaagugcugcguggagugccccgccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31229 - RNA, 642 nt, Artificial Sequence
  derived and/or modified sequence opt4 from Panitumumab_LightChain1
gacauccagaugacccagagccccagcagccugagcgccagcgugggcgacagagugaccaucaccugccaggccagccaggacaucagcaacuaccugaacugguaccagcagaagcccggcaaggcccccaagcugcugaucuacgacgccagcaaccuggagaccggcgugcccagcagauucagcggcagcggcagcggcaccgacuucaccuucaccaucagcagccugcagcccgaggacaucgccaccuacuucugccagcacuucgaccaccugccccuggccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31230 - RNA, 1326 nt, Artificial Sequence
  derived and/or modified sequence opt4 from Pankoab_HeavyChain1
gaggugcagcugguggagagcggcggcggccuggugcagcccggcggcagcagacugagcugcguggccagcggcuuccccuucagcaacuacuggaacugggugagacaggcccccggcaagggccuggagugggugggcgagaucagacugaagagcaacaacuacaccacccacuacgccgagagcgugaagggcagauucaccaucagcagagacgacagcaagaacagccuguaccugcagaacagccugaagaccgaggacaccgccguguacuacugcaccagacacuacuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgagggccugcacaaccacuacacccagaagagccugagccugagccccggcaag

SEQ ID NO: 31231 - RNA, 651 nt, Artificial Sequence
  derived and/or modified sequence opt4 from Pankoab_LightChain1
gacaucgugacccagagcccccugagcaaccccgugacccccggcgagcccgccagcaucagcugcagaagcagcaagagccugcugcacagcaacggcaucaccuacuucuucugguaccugcagaagcccggccagagcccccagcugcugaucuaccagagcaaccuggccagcggcgugcccgacagauucagcggcagcggcagcggcaccgacuucacccugagaaucagcagaguggaggccgaggacgugggcguguacuacugcgcccagaaccuggagcugccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31232 - RNA, 651 nt, Artificial Sequence
  derived and/or modified sequence opt4 from Pankoab_LightChain2
gacaucgugacccagagcccccugagcaaccccgugacccccggcgagcccgccagcaucagcugcagaagcagcaagagccugcugcacagcaacggcaucaccuacuucuucugguaccugcagaagcccggccagagcccccagcugcugaucuaccagagcaaccuggccagcggcgugcccgacagauucagcggcagcggcagcggcaccgacuucacccugagaaucagcagaguggaggccgaggacgugggcguguacuacugcgccggcaaccuggagcugccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31233 - RNA, 351 nt, Artificial Sequence
  derived and/or modified sequence opt4 from PankoMab_HeavyChain_VDJ-Region
gaggugaagcugguggagagcggcggcggccuggugcagcccggcggcagcaugaagcugagcugcguggccagcggcuucaccuucagcaacuacuggaugaacugggugagacagagccccgagaagggccuggaguggguggccgagaucagacugaagagcaacaacuacaccacccacuacgccgagagcgugaagggcagauucaccaucagcagagacgacagcaagagcagcgugagccugcagaugaacaaccugagaguggaggacaccggcaucuacuacugcaccagacacuacuacuucgacuacuggggccagggcaccacccugaccgugagcagc

SEQ ID NO: 31234 - RNA, 339 nt, Artificial Sequence
  derived and/or modified sequence opt4 from PankoMab_LightChain_VJ-Region
gacaucgugaugacccaggccgccuucagcaaccccgugacccugggcaccagcgccagcaucagcugcagaagcagcaagagccugcugcacagcaacggcaucaccuacuucuucugguaccugcagaagcccggccugagcccccagcugcugaucuaccagaugagcaaccuggccagcggcgugcccgacagauucagcagcagcggcagcggcaccgacuucacccugagaaucagcagaguggaggccgaggacgugggcguguacuacugcgcccagaaccuggagcugccccccaccuucggcggcggcaccaagcuggagaucaagaga

SEQ ID NO: 31235 - RNA, 1707 nt, Artificial Sequence
  derived and/or modified sequence opt4 from Panobacumab_HeavyChain1
gaggagcaggugguggagagcggcggcggcuucgugcagcccggcggcagccugagacugagcugcgccgccagcggcuucaccuucagccccuacuggaugcacugggugagacaggcccccggcaagggccuggugugggugagcagaaucaacagcgacggcagcaccuacuacgccgacagcgugaagggcagauucaccaucagcagagacaacgccagaaacacccuguaccugcagaugaacagccugagagccgaggacaccgccguguacuacugcgccagagacagauacuacggccccgagauguggggccagggcaccauggugaccgugagcagcggcagcgccagcgcccccacccuguucccccuggugagcugcgagaacagccccagcgacaccagcagcguggccgugggcugccuggcccaggacuuccugcccgacagcaucaccuucagcuggaaguacaagaacaacagcgacaucagcagcaccagaggcuuccccagcgugcugagaggcggcaaguacgccgccaccagccaggugcugcugcccagcaaggacgugaugcagggcaccgacgagcacguggugugcaaggugcagcaccccaacggcaacaaggagaagaacgugccccugcccgugaucgccgagcugccccccaaggugagcguguucgugccccccagagacggcuucuucggcaaccccagaaagagcaagcugaucugccaggccaccggcuucagccccagacagauccaggugagcuggcugagagagggcaagcaggugggcagcggcgugaccaccgaccaggugcaggccgaggccaaggagagcggccccaccaccuacaaggugaccagcacccugaccaucaaggagagcgacuggcugagccagagcauguucaccugcagaguggaccacagaggccugaccuuccagcagaacgccagcagcaugugcgugcccgaccaggacaccgccaucagaguguucgccaucccccccagcuucgccagcaucuuccugaccaagagcaccaagcugaccugccuggugaccgaccugaccaccuacgacagcgugaccaucagcuggaccagacagaacggcgaggccgugaagacccacaccaacaucagcgagagccaccccaacgccaccuucagcgccgugggcgaggccagcaucugcgaggacgacuggaacagcggcgagagauucaccugcaccgugacccacaccgaccugcccagcccccugaagcagaccaucagcagacccaagggcguggcccugcacagacccgacguguaccugcugccccccgccagagagcagcugaaccugagagagagcgccaccaucaccugccuggugaccggcuucagccccgccgacguguucgugcaguggaugcagagaggccagccccugagccccgagaaguacgugaccagcgcccccaugcccgagccccaggcccccggcagauacuucgcccacagcauccugaccgugagcgaggaggaguggaacaccggcgagaccuacaccugcgugguggcccacgaggcccugcccaacagagugaccgagagaaccguggacaagagcaccggcaagcccacccuguacaacgugagccuggugaugagcgacaccgccggcaccugcuac

SEQ ID NO: 31236 - RNA, 657 nt, Artificial Sequence
  derived and/or modified sequence opt4 from Panobacumab_LightChain1
gacguggugaugacccagagcccccugagccugcccgugacccugggccagcccgccagcaucagcugcagaagcagccagagccugguguacagcgacggcaacaccuaccugaacugguuccagcagagacccggccagagccccagaagacugaucuacaaggugagcaacagagacagcggcgugcccgacagauucagcggcagcggcagcggcaccgacuucacccugaagaucagcagaguggaggccgaggacgugggcguguacuacugcaugcagggcacccacuggccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31237 - RNA, 414 nt, Artificial Sequence
  derived and/or modified sequence opt4 from Panobacumab_LightChain2
ggcgacgacgaggccaccauccuggccgacaacaagugcaugugcaccagagugaccagcagaaucauccccagcaccgaggaccccaacgaggacaucguggagagaaacaucagaaucguggugccccugaacaacagagagaacaucagcgaccccaccagcccccugagaagaaacuucguguaccaccugagcgacgugugcaagaagugcgaccccguggagguggagcuggaggaccagguggugaccgccacccagagcaacaucugcaacgaggacgacggcgugcccgagaccugcuacauguacgacagaaacaagugcuacaccaccauggugccccugagauaccacggcgagaccaagauggugcaggccgcccugacccccgacagcugcuaccccgac

SEQ ID NO: 31238 - RNA, 1359 nt, Artificial Sequence
  derived and/or modified sequence opt4 from Parsatuzumab_HeavyChain1
gaggugcagcugguggagagcggcggcggccuggugcagcccggcggcagccugagacugagcugcgccgccagcggcuacaccuucaucgacuacuacaugaacugggugagacaggcccccggcaagggccuggagugggugggcgacaucaaccuggacaacagcggcacccacuacaaccagaaguucaagggcagauucaccaucagcagagacaagagcaagaacaccgccuaccugcagaugaacagccugagagccgaggacaccgccguguacuacugcgccagagagggcguguaccacgacuacgacgacuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31239 - RNA, 657 nt, Artificial Sequence
  derived and/or modified sequence opt4 from Parsatuzumab_LightChain1
gacauccagaugacccagagccccagcagccugagcgccagcgugggcgacagagugaccaucaccugcagaaccagccagagccuggugcacaucaacgccaucaccuaccugcacugguaccagcagaagcccggcaaggcccccaagcugcugaucuacagagugagcaacagauucagcggcgugcccagcagauucagcggcagcggcagcggcaccgacuucacccugaccaucagcagccugcagcccgaggacuucgccaccuacuacugcggccagagcacccacgugccccugaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31240 - RNA, 1353 nt, Artificial Sequence
  derived and/or modified sequence opt4 from Pascolizumab_HeavyChain1
caggugacccugagagagagcggccccgcccuggugaagcccacccagacccugacccugaccugcaccuucagcggcuucagccugagcaccagcggcaugggcgugagcuggaucagacagccccccggcaagggccuggaguggcuggcccacaucuacugggacgacgacaagagauacaaccccagccugaagagcagacugaccaucagcaaggacaccagcagaaaccagguggugcugaccaugaccaacauggaccccguggacaccgccaccuacuacugcgccagaagagagaccguguucuacugguacuucgacguguggggcagaggcacccccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31241 - RNA, 654 nt, Artificial Sequence
  derived and/or modified sequence opt4 from Pascolizumab_LightChain1
gacaucgugcugacccagagccccagcagccugagcgccagcgugggcgacagagugaccaucaccugcaaggccagccagagcguggacuacgacggcgacagcuacaugaacugguaccagcagaagcccggcaaggcccccaagcugcugaucuacgccgccagcaaccuggagagcggcauccccagcagauucagcggcagcggcagcggcaccgacuucaccuucaccaucagcagccugcagcccgaggacaucgccaccuacuacugccagcagagcaacgaggacccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31242 - RNA, 1512 nt, Artificial Sequence
  derived and/or modified sequence opt4 from Pasotuxizumab_HeavyChain1
caggugcagcugguggagagcggcggcggccuggugaagcccggcgagagccugagacugagcugcgccgccagcggcuucaccuucagcgacuacuacauguacugggugagacaggcccccggcaagggccuggaguggguggccaucaucagcgacggcggcuacuacaccuacuacagcgacaucaucaagggcagauucaccaucagcagagacaacgccaagaacagccuguaccugcagaugaacagccugaaggccgaggacaccgccguguacuacugcgccagaggcuucccccugcugagacacggcgccauggacuacuggggccagggcacccuggugaccgugagcagcggcggcggcggcagcggcggcggcggcagcggcggcggcggcagcgacauccagaugacccagagccccagcagccugagcgccagcgugggcgacagagugaccaucaccugcaaggccagccagaacguggacaccaacguggccugguaccagcagaagcccggccaggcccccaagagccugaucuacagcgccagcuacagauacagcgacgugcccagcagauucagcggcagcgccagcggcaccgacuucacccugaccaucagcagcgugcagagcgaggacuucgccaccuacuacugccagcaguacgacagcuaccccuacaccuucggcggcggcaccaagcuggagaucaagagcggcggcggcggcagcgaggugcagcugguggagagcggcggcggccuggugcagcccggcggcagccugaagcugagcugcgccgccagcggcuucaccuucaacaaguacgccaugaacugggugagacaggcccccggcaagggccuggaguggguggccagaaucagaagcaaguacaacaacuacgccaccuacuacgccgacagcgugaaggacagauucaccaucagcagagacgacagcaagaacaccgccuaccugcagaugaacaaccugaagaccgaggacaccgccguguacuacugcgugagacacggcaacuucggcaacagcuacaucagcuacugggccuacuggggccagggcacccuggugaccgugagcagcggcggcggcggcagcggcggcggcggcagcggcggcggcggcagccagaccguggugacccaggagcccagccugaccgugagccccggcggcaccgugacccugaccugcggcagcagcaccggcgccgugaccagcggcaacuaccccaacugggugcagcagaagcccggccaggcccccagaggccugaucggcggcaccaaguuccuggcccccggcacccccgccagauucagcggcagccugcugggcggcaaggccgcccugacccugagcggcgugcagcccgaggacgaggccgaguacuacugcgugcugugguacagcaacagauggguguucggcggcggcaccaagcugaccgugcugcaccaccaccaccaccac

SEQ ID NO: 31243 - RNA, 1512 nt, Artificial Sequence
  derived and/or modified sequence opt4 from Pasotuxizumab_SingleChain
caggugcagcuggugcagagcggcggcggccuggugaagcccggcgagagccugagacugagcugcgccgccagcggcuucaccuucagcgacuacuacauguacugggugagacaggcccccggcaagggccuggaguggguggccaucaucagcgacggcggcuacuacaccuacuacagcgacaucaucaagggcagauucaccaucagcagagacaacgccaagaacagccuguaccugcagaugaacagccugaaggccgaggacaccgccguguacuacugcgccagaggcuucccccugcugagacacggcgccauggacuacuggggccagggcacccuggugaccgugagcagcggcggcggcggcagcggcggcggcggcagcggcggcggcggcagcgacauccagaugacccagagccccagcagccugagcgccagcgugggcgacagagugaccaucaccugcaaggccagccagaacguggacaccaacguggccugguaccagcagaagcccggccaggcccccaagagccugaucuacagcgccagcuacagauacagcgacgugcccagcagauucagcggcagcgccagcggcaccgacuucacccugaccaucagcagcgugcagagcgaggacuucgccaccuacuacugccagcaguacgacagcuaccccuacaccuucggcggcggcaccaagcuggagaucaagagcggcggcggcggcagcgaggugcagcugguggagagcggcggcggccuggugcagcccggcggcagccugaagcugagcugcgccgccagcggcuucaccuucaacaaguacgccaugaacugggugagacaggcccccggcaagggccuggaguggguggccagaaucagaagcaaguacaacaacuacgccaccuacuacgccgacagcgugaaggacagauucaccaucagcagagacgacagcaagaacaccgccuaccugcagaugaacaaccugaagaccgaggacaccgccguguacuacugcgugagacacggcaacuucggcaacagcuacaucagcuacugggccuacuggggccagggcacccuggugaccgugagcagcggcggcggcggcagcggcggcggcggcagcggcggcggcggcagccagaccguggugacccaggagcccagccugaccgugagccccggcggcaccgugacccugaccugcggcagcagcaccggcgccgugaccagcggcaacuaccccaacugggugcagcagaagcccggccaggcccccagaggccugaucggcggcaccaaguuccuggcccccggcacccccgccagauucagcggcagccugcugggcggcaaggccgcccugacccugagcggcgugcagcccgaggacgaggccgaguacuacugcgugcugugguacagcaacagauggguguucggcggcggcaccaagcugaccgugcugcaccaccaccaccaccac

SEQ ID NO: 31244 - RNA, 1341 nt, Artificial Sequence
  derived and/or modified sequence opt4 from Pateclizumab_HeavyChain1
gaggugcagcugguggagagcggcggcggccuggugcagcccggcggcagccugagacugagcugcgccgccagcggcuacaccuucaccagcuacgugauccacugggugagacaggcccccggcaagggccuggagugggugggcuacaacaaccccuacaacgccggcaccaacuacaacgagaaguucaagggcagauucaccaucagcagcgacaagagcaagaacaccgccuaccugcagaugaacagccugagagccgaggacaccgccguguacuacugcagcagacccaccaugcugcccugguucgccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31245 - RNA, 642 nt, Artificial Sequence
  derived and/or modified sequence opt4 from Pateclizumab_LightChain1
gacauccagaugacccagagccccagcagccugagcgccagcgugggcgacagagugaccaucaccugcagagccagccaggccgugagcagcgccguggccugguaccagcagaagcccggcaaggcccccaagcugcugaucuacagcgccagccacagauacaccggcgugcccagcagauucagcggcagcggcagcggcaccgacuucacccugaccaucagcagccugcagcccgaggacuucgccaccuacuacugccaggagagcuacagcacccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31246 - RNA, 1341 nt, Artificial Sequence
  derived and/or modified sequence opt4 from Patritumab_HeavyChain1
caggugcagcugcagcaguggggcgccggccugcugaagcccagcgagacccugagccugaccugcgccguguacggcggcagcuucagcggcuacuacuggagcuggaucagacagccccccggcaagggccuggaguggaucggcgagaucaaccacagcggcagcaccaacuacaaccccagccugaagagcagagugaccaucagcguggagaccagcaagaaccaguucagccugaagcugagcagcgugaccgccgccgacaccgccguguacuacugcgccagagacaaguggaccugguacuucgaccuguggggcagaggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31247 - RNA, 681 nt, Artificial Sequence; identical to SEQ ID NO: 31203
  derived and/or modified sequence opt4 from Patritumab_hinge-CH2-CH3

SEQ ID NO: 31248 - RNA, 660 nt, Artificial Sequence
  derived and/or modified sequence opt4 from Patritumab_LightChain1
gacaucgagaugacccagagccccgacagccuggccgugagccugggcgagagagccaccaucaacugcagaagcagccagagcgugcuguacagcagcagcaacagaaacuaccuggccugguaccagcagaaccccggccagccccccaagcugcugaucuacugggccagcaccagagagagcggcgugcccgacagauucagcggcagcggcagcggcaccgacuucacccugaccaucagcagccugcaggccgaggacguggccguguacuacugccagcaguacuacagcacccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31249 - RNA, 1341 nt, Artificial Sequence; identical to SEQ ID NO: 31064
  derived and/or modified sequence opt4 from Pembrolizumab_HeavyChain1

SEQ ID NO: 31250 - RNA, 654 nt, Artificial Sequence; identical to SEQ ID NO: 31065
  derived and/or modified sequence opt4 from Pembrolizumab_LightChain1

SEQ ID NO: 31251 - RNA, 1356 nt, Artificial Sequence
  derived and/or modified sequence opt4 from Perakizumab_HeavyChain1
gaggugcagcugguggagagcggcggcggccuggugcagcccggcggcagccugagacugagcugcgccgccagcggcuucaccuucagcgacuacaccaugcugugggugagacaggcccccggcaagggccuggaguggguggccaucaucaagagcggcggcagcuacagcuacuaccccgacagcgugaagggcagauucaccaucagcagagacaacgccaagaacagccuguaccugcagaugaacagccugagagccgaggacaccgccguguacuacugcgccagagacggcgacuacggcagcagcuacggcgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31252 - RNA, 645 nt, Artificial Sequence
  derived and/or modified sequence opt4 from Perakizumab_LightChain1
gacauccagaugacccagagccccagcagccugagcgccagcgugggcgacagagugaccaucaccugcagagccagccaggacaucaacagcuaccugagcugguuccagcagaagcccggcaaggcccccaagagccugaucgugagagccaacagacugguggacggcgugcccagcagauucagcggcagcggcagcggccaggacuacagccugaccaucagcagccugcagcccgaggacuucgccaccuacuacugccugcaguacgacgccuucccccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31253 - RNA, 1332 nt, Artificial Sequence
  derived and/or modified sequence opt4 from Pertuzuab_HeavyChain1
gaggugcagcugguggagagcggcggcggccuggugcagcccggcggcagccugagacugagcugcgccgccagcggcuucaccuucaccgacuacaccgacugggugagacaggcccccggcaagggccuggaguggguggccgacgugaaccccaacagcggcggcagcaucuacaaccagagauucaagggcagauucacccugagcguggacagaagcaagaacacccuguaccugcagaacagccugagagccgaggacaccgccguguacuacugcgccagaaaccugggccccagcuucuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggcaag

SEQ ID NO: 31254 - RNA, 639 nt, Artificial Sequence
  derived and/or modified sequence opt4 from Pertuzuab_LightChain1
gacauccagacccagagccccagcagccugagcgccagcgugggcgacagagugaccaucaccugcaaggccagccaggacgugagcaucggcguggccugguaccagcagaagcccggcaaggcccccaagcugcugaucuacagcgccagcuacagauacaccggcgugcccagcagauucagcggcagcggcagcggcaccgacuucacccugaccaucagcagccugcagcccgaggacuucgccaccuacuacugccagcaguacuacaucuaccccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31255 - RNA, 642 nt, Artificial Sequence
  derived and/or modified sequence opt4 from Pertuzumab_HeavyChain
gacauccagaugacccagagccccagcagccugagcgccagcgugggcgacagagugaccaucaccugcaaggccagccaggacgugagcaucggcguggccugguaccagcagaagcccggcaaggcccccaagcugcugaucuacagcgccagcuacagauacaccggcgugcccagcagauucagcggcagcggcagcggcaccgacuucacccugaccaucagcagccugcagcccgaggacuucgccaccuacuacugccagcaguacuacaucuaccccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31256 - RNA, 1344 nt, Artificial Sequence
  derived and/or modified sequence opt4 from Pertuzumab_LightChain
gaggugcagcugguggagagcggcggcggccuggugcagcccggcggcagccugagacugagcugcgccgccagcggcuucaccuucaccgacuacaccauggacugggugagacaggcccccggcaagggccuggaguggguggccgacgugaaccccaacagcggcggcagcaucuacaaccagagauucaagggcagauucacccugagcguggacagaagcaagaacacccuguaccugcagaugaacagccugagagccgaggacaccgccguguacuacugcgccagaaaccugggccccagcuucuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31257 - RNA, 750 nt, Artificial Sequence
  derived and/or modified sequence opt4 from Pexelizumab_h5g1.1-scFv
auggccgacauccagaugacccagagccccagcagccugagcgccagcgugggcgacagagugaccaucaccugcggcgccagcgagaacaucuacggcgcccugaacugguaccagagaaagcccggcaaggcccccaagcugcugaucuacggcgccaccaaccuggccgacggcgugcccagcagauucagcggcagcggcagcggcaccgacuacacccugaccaucagcagccugcagcccgaggacuucgccaccuacuacugccagaacgugcugaacaccccccugaccuucggccagggcaccaagguggagaucaagagaaccggcggcggcggcagcggcggcggcggcagcggcggcggcggcagccaggugcagcuggugcagagcggcgccgagguggagaagcccggcgccagcgugaagaaggugagcugcaaggccagcggcuacaucuucagcaacuacuggauccagugggugagacaggcccccggccagggccuggaguggaugggcgagauccugcccggcagcggcagcaccgaguacgcccagaaguuccagggcagagugaccaugaccgccgacaccagcaccagcaccgccuacauggagcugagcagccugagaagcgaggacaccgccguguacuacugcgccagauacuucuucggcagcagccccaacuacugguacuucgacguguggggccagggcacccuggugaccgugagcagc

SEQ ID NO: 31258 - RNA, 345 nt, Artificial Sequence
  derived and/or modified sequence opt4 from Pexelizumab_h5g1.1VHC_+_F_Heavy_Chain_V-Region
caggugcagcuggugcagagcggcgccgaggugaagaagcccggcgccagcgugaaggugagcugcaaggccagcggcuacaucuucagcaacuacuggauccagugggugagacaggcccccggccagggccuggaguggaugggcgagauccugcccggcagcggcagcaccgaguacgcccagaaguuccagggcagagugaccaugaccgccgacaccagcaccagcaccgccuacauggagcugagcagccugagaagcgaggacaccgccguguacuacugcgccagauacuucuucggcagcagccccaacugguacuucguguggggccagggcacc

SEQ ID NO: 31259 - RNA, 318 nt, Artificial Sequence
  derived and/or modified sequence opt4 from Pexelizumab_h5g1.1VHC_+_F_Light_Chain_V-Region
gacauccagaugacccagagccccagccugagcgccagcgugggcgacagagugaccaucaccugcggcgccagcgagaacaucuacggcgcccugaacugguaccagagaaagcccggcaaggcccccaagcugcugaucuacggcgccaccaaccuggccgacggcgugcccagcagauucagcggcagcggcagcggcaccgacuacacccugaccaucagcagccugcagcccgaggacuucgccaccuacuacugccagaacgugcugaacaccccccugaccuucggccagggcaccaagguggagaucaag

SEQ ID NO: 31260 - RNA, 1326 nt, Artificial Sequence
  derived and/or modified sequence opt4 from PF-05082566_HeavyChain1
gaggugcagcuggugcagagcggcgccgaggugaagaagcccggcgagagccugagaaucagcugcaagggcagcggcuacagcuucagcaccuacuggaucagcugggugagacagaugcccggcaagggccuggaguggaugggcaagaucuaccccggcgacagcuacaccaacuacagccccagcuuccagggccaggugaccaucagcgccgacaagagcaucagcaccgccuaccugcaguggagcagccugaaggccagcgacaccgccauguacuacugcgccagaggcuacggcaucuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31261 - RNA, 642 nt, Artificial Sequence
  derived and/or modified sequence opt4 from PF-05082568_LightChain1
agcuacgagcugacccagccccccagcgugagcgugagccccggccagaccgccagcaucaccugcagcggcgacaacaucggcgaccaguacgcccacugguaccagcagaagcccggccagagccccgugcuggugaucuaccaggacaagaacagacccagcggcauccccgagagauucagcggcagcaacagcggcaacaccgccacccugaccaucagcggcacccaggccauggacgaggccgacuacuacugcgccaccuacaccggcuucggcagccuggccguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31262 - RNA, 1341 nt, Artificial Sequence
  derived and/or modified sequence opt4 from Pidilizumab_HeavyChain1
caggugcagcuggugcagagcggcagcgagcugaagaagcccggcgccagcgugaagaucagcugcaaggccagcggcuacaccuucaccaacuacggcaugaacugggugagacaggcccccggccagggccugcaguggaugggcuggaucaacaccgacagcggcgagagcaccuacgccgaggaguucaagggcagauucguguucagccuggacaccagcgugaacaccgccuaccugcagaucaccagccugaccgccgaggacaccggcauguacuucugcgugagagugggcuacgacgcccuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31263 - RNA, 639 nt, Artificial Sequence
  derived and/or modified sequence opt4 from Pidilizumab_LightChain1
gagaucgugcugacccagagccccagcagccugagcgccagcgugggcgacagagugaccaucaccugcagcgccagaagcagcgugagcuacaugcacugguuccagcagaagcccggcaaggcccccaagcuguggaucuacagaaccagcaaccuggccagcggcgugcccagcagauucagcggcagcggcagcggcaccagcuacugccugaccaucaacagccugcagcccgaggacuucgccaccuacuacugccagcagagaagcagcuucccccugaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31264 - RNA, 1350 nt, Artificial Sequence
  derived and/or modified sequence opt4 from Pinatuzumab_vedotin_HeavyChain1
gaggugcagcugguggagagcggcggcggccuggugcagcccggcggcagccugagacugagcugcgccgccagcggcuacgaguucagcagaagcuggaugaacugggugagacaggcccccggcaagggccuggagugggugggcagaaucuaccccggcgacggcgacaccaacuacagcggcaaguucaagggcagauucaccaucagcgccgacaccagcaagaacaccgccuaccugcagaugaacagccugagagccgaggacaccgccguguacuacugcgccagagacggcagcagcugggacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31265 - RNA, 657 nt, Artificial Sequence
  derived and/or modified sequence opt4 from Pinatuzumab_vedotin_LightChain1
gacauccagaugacccagagccccagcagccugagcgccagcgugggcgacagagugaccaucaccugcagaagcagccagagcaucgugcacagcgugggcaacaccuuccuggagugguaccagcagaagcccggcaaggcccccaagcugcugaucuacaaggugagcaacagauucagcggcgugcccagcagauucagcggcagcggcagcggcaccgacuucacccugaccaucagcagccugcagcccgaggacuucgccaccuacuacugcuuccagggcagccaguuccccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31266 - RNA, 1023 nt, Artificial Sequence
  derived and/or modified sequence opt4 from Placulumab_chain1
gacauccagaugacccagagccccagcagccugagcgccagcgugggcgacagagugaccaucaccugcagagccagccaggccaucgacagcuaccugcacugguaccagcagaagcccggcaaggcccccaagcugcugaucuacagcgccagcaaccuggagaccggcgugcccagcagauucagcggcagcggcagcggcaccgacuucacccugaccaucagcagccugcugcccgaggacuucgccaccuacuacugccagcaggugguguggagacccuucaccuucggccagggcaccaagguggagaucaagagaguggagcccaagagcagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31267 - RNA, 1023 nt, Artificial Sequence; identical to SEQ ID NO: 31266
  derived and/or modified sequence opt4 from Placulumab_HeavyChain1

SEQ ID NO: 31268 - RNA, 1341 nt, Artificial Sequence
  derived and/or modified sequence opt4 from Plozalizumab_HeavyChain1
gaggugcagcugguggagagcggcggcggccuggugaagcccggcggcagccugagacugagcugcgccgccagcggcuucaccuucagcgccuacgccaugaacugggugagacaggcccccggcaagggccuggagugggugggcagaaucagaaccaagaacaacaacuacgccaccuacuacgccgacagcgugaaggacagauucaccaucagcagagacgacagcaagaacacccuguaccugcagaugaacagccugaagaccgaggacaccgccguguacuacugcaccaccuucuacggcaacggcguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcuggccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31269 - RNA, 657 nt, Artificial Sequence
  derived and/or modified sequence opt4 from Plozalizumab_LightChain1
gacguggugaugacccagagcccccugagccugcccgugacccugggccagcccgccagcaucagcugcaagagcagccagagccugcuggacagcgacggcaagaccuuccugaacugguuccagcagagacccggccagagccccagaagacugaucuaccuggugagcaagcuggacagcggcgugcccgacagauucagcggcagcggcagcggcaccgacuucacccugaagaucagcagaguggaggccgaggacgugggcguguacuacugcuggcagggcacccacuuccccuacaccuucggccagggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31270 - RNA, 1341 nt, Artificial Sequence
  derived and/or modified sequence opt4 from Pogalizumab_HeavyChain1
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacggcgacagcagcuacaaccagaaguucagagagagagugaccaucaccagagacaccagcaccagcaccgccuaccuggagcugagcagccugagaagcgaggacaccgccguguacuacugcgugcuggcccccagaugguacuucagcguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31271 - RNA, 642 nt, Artificial Sequence
  derived and/or modified sequence opt4 from Pogalizumab_LightChain1
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcagacugagaagcggcgugcccagcagauucagcggcagcggcagcggcaccgacuucacccugaccaucagcagccugcagcccgaggacuucgccaccuacuacugccagcagggccacacccugccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31272 - RNA, 1341 nt, Artificial Sequence
  derived and/or modified sequence opt4 from Polatuzumab_vedotin_HeavyChain1
gaggugcagcugguggagagcggcggcggccuggugcagcccggcggcagccugagacugagcugcgccgccagcggcuacaccuucagcagcuacuggaucgagugggugagacaggcccccggcaagggccuggaguggaucggcgagauccugcccggcggcggcgacaccaacuacaacgagaucuucaagggcagagccaccuucagcgccgacaccagcaagaacaccgccuaccugcagaugaacagccugagagccgaggacaccgccguguacuacugcaccagaagagugcccaucagacuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31273 - RNA, 654 nt, Artificial Sequence
  derived and/or modified sequence opt4 from Polatuzumab_vedotin_LightChain1
gacauccagcugacccagagccccagcagccugagcgccagcgugggcgacagagugaccaucaccugcaaggccagccagagcguggacuacgagggcgacagcuuccugaacugguaccagcagaagcccggcaaggcccccaagcugcugaucuacgccgccagcaaccuggagagcggcgugcccagcagauucagcggcagcggcagcggcaccgacuucacccugaccaucagcagccugcagcccgaggacuucgccaccuacuacugccagcagagcaacgaggacccccugaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31274 - RNA, 1326 nt, Artificial Sequence
  derived and/or modified sequence opt4 from Ponezumab_HeavyChain1
caggugcagcuggugcagagcggcgccgaggugaagaagcccggcgccagcgugaaggugagcugcaaggccagcggcuacuacaccgaggccuacuacauccacugggugagacaggcccccggccagggccuggaguggaugggcagaaucgaccccgccaccggcaacaccaaguacgcccccagacugcaggacagagugaccaugaccagagacaccagcaccagcaccguguacauggagcugagcagccugagaagcgaggacaccgccguguacuacugcgccagccuguacagccugcccguguacuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccagcagcaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31275 - RNA, 657 nt, Artificial Sequence
  derived and/or modified sequence opt4 from Ponezumab_LightChain1
gacguggugaugacccagagcccccugagccugcccgugacccugggccagcccgccagcaucagcugcaagagcagccagagccugcuguacagcgacgccaagaccuaccugaacugguuccagcagagacccggccagagccccagaagacugaucuaccagaucagcagacuggaccccggcgugcccgacagauucagcggcagcggcagcggcaccgacuucacccugaagaucagcagaguggaggccgaggacgugggcguguacuacugccugcagggcacccacuaccccgugcuguucggccagggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31276 - RNA, 1362 nt, Artificial Sequence
  derived and/or modified sequence opt4 from Pritoxaximab_HeavyChain1
caggugcagcugcaggagagcggcgccgagcuggugagaagcggcgccagcgugagaaugagcugcaaggccagcggcuacaccuucaccagcuacaacaugcacugggugaagcagacccccggccagggccuggaguggaucggcuacaucuaccccggcaacggcggcaccaacuacauccagaaguucaagggcaaggccauccugaccgccgacaccagcagcagcaccgccuacaugcagaucagcagccugaccagcgaggacagcgccguguacuucugcaccagaagccccagccacuacagcagcgaccccuacuucgacuacuggggccagggcaccacccugaccgugagcagcgaguucgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31277 - RNA, 642 nt, Artificial Sequence
  derived and/or modified sequence opt4 from Pritoxaximab_LightChain1
gacaucgugaugagccagagccacaaguucaugagcaccagcgugggcgacagagugagcaucaccugcaaggccagccaggacgugggcaccgccguggccugguaccagcagaaccccggccagagccccaaguuccugaucuacugggccagcaccagacacaccggcgugcccgacagauucaccggcagcggcagcggcaccgacuucacccugaccaucaccaacgugcagagcgaggaccuggccgacuacuucugccagcaguacagcagcuacccccugaccuucggcgccggcaccagccuggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31278 - RNA, 1350 nt, Artificial Sequence
  derived and/or modified sequence opt4 from Pritumumab_HeavyChain1
gaggugcagcugcuggagagcggcggcgaccuggugcagcccggcggcagccugagacugagcugcgccgccagcggcuucaccuucagcaacuacgccaugagcugggugagacaggcccccggcaagggccuggagugggugagcgccaucacccccagcggcggcagcaccaacuacgccgacagcgugaagggcagauucaccaucagcagagacaacagccagaacacccuguaccugcagaugaacagccugagaguggaggacaccgccguguacaucugcggcagagugcccuacagaagcaccugguacccccuguacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31279 - RNA, 642 nt, Artificial Sequence
  derived and/or modified sequence opt4 from Pritumumab_LightChain1
gacauccagaugacccagagccccagcagccugagcgccagcgugggcgacagagugaccaucaccugcagagccagccaggacaucagcaacuaccuggccugguuccagcagaagcccggcaaggcccccaagagccugaucuacgccgccagcagccugcacagcaaggugcccacccaguucagcggcagcggcagcggcaccgacuucacccugaccaucagcagccugcagcccgaggacuucgccaccuacuacugccugcaguacagcaccuaccccaucaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31280 - RNA, 1341 nt, Artificial Sequence
  derived and/or modified sequence opt4 from Quilizumab_HeavyChain1
gaggugcagcugguggagagcggcggcggccuggugcagcccggcggcagccugagacugagcugcgccgccagcggcuucaccuucagcgacuacggcaucgccugggugagacaggcccccggcaagggccuggaguggguggccuucaucagcgaccuggccuacaccaucuacuacgccgacaccgugaccggcagauucaccaucagcagagacaacagcaagaacacccuguaccugcagaugaacagccugagagccgaggacaccgccguguacuacugcgccagagacaacugggacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31281 - RNA, 657 nt, Artificial Sequence
  derived and/or modified sequence opt4 from Quilizumab_LightChain1
gacauccagaugacccagagccccagcagccugagcgccagcgugggcgacagagugaccaucaccugcagaagcagccagagccuggugcacaacaacgccaacaccuaccugcacugguaccagcagaagcccggcaaggcccccaagcugcugaucuacaaggugagcaacagauucagcggcgugcccagcagauucagcggcagcggcagcggcaccgacuucacccugaccaucagcagccugcagcccgaggacuucgccaccuacuacugcagccagaacacccuggugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31282 - RNA, 1335 nt, Artificial Sequence
  derived and/or modified sequence opt4 from Racotumomab_HeavyChain1
caggugcagcugcagcagagcggcgccgagcuggugaagcccggcgccagcgugaagcugagcugcaaggccagcggcuacaccuucaccagcuacgacaucaacugggugagacagagacccgagcagggccuggaguggaucggcuggaucuuccccggcgacggcagcaccaaguacaacgagaaguucaagggcaaggccacccugaccaccgacaagagcagcagcaccgccuacaugcagcugagcagacugaccagcgaggacagcgccguguacuucugcgccagagaggacuacuacgacaacagcuacuacuucgacuacuggggccagggcaccacccugaccgugagcagcgccaagaccaccccccccagcguguacccccuggcccccggcagcgccgcccagaccaacagcauggugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagccccagacccagcgagaccgugaccugcaacguggcccaccccgccagcagcaccaagguggacaagaagaucgugcccagagacugcggcugcaagcccugcaucugcaccgugcccgaggugagcagcguguucaucuucccccccaagcccaaggacgugcugaccaucacccugacccccaaggugaccugcguggugguggacaucagcaaggacgaccccgaggugcaguucagcugguucguggacgacguggaggugcacaccgcccagacccagcccagagaggagcaguucaacagcaccuucagaagcgugagcgagcugcccaucaugcaccaggacuggcugaacggcaaggaguucaagugcagagugaacagcgccgccuuccccgcccccaucgagaagaccaucagcaagaccaagggcagacccaaggccccccagguguacaccauccccccccccaaggagcagauggccaaggacaaggugagccugaccugcaugaucaccgacuucuuccccgaggacaucaccguggaguggcaguggaacggccagcccgccgagaacuacaagaacacccagcccaucaugaacaccaacggcagcuacuucguguacagcaagcugaacgugcagaagagcaacugggaggccggcaacaccuucaccugcagcgugcugcacgagggccugcacaaccaccacaccgagaagagccugagccacagccccggcaag

SEQ ID NO: 31283 - RNA, 642 nt, Artificial Sequence
  derived and/or modified sequence opt4 from Racotumomab_LightChain1
gacauccagaugacccagaccaccagcagccugagcgccagccugggcgacagagugaccaucagcugcagagccagccaggacaucagcaacuaccugaacugguaccagcagaagcccgacggcaccgugaagcugcugaucuacuacaccagcagacugcacagcggcgugcccagcagauucagcggcagcggcagcggcaccgacuacagccugaccaucagcaaccuggagcaggaggacaucgccaccuacuucugccagcagggcaacacccugcccuggaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 31284 - RNA, 1089 nt, Artificial Sequence; identical to SEQ ID NO: 31222
  derived and/or modified sequence opt4 from Racotumomab_scVH-VH'-VH_chain

SEQ ID NO: 31285 - RNA, 1071 nt, Artificial Sequence
  derived and/or modified sequence opt4 from Radretumab_HeavyChain1
gaggugcagcugcuggagagcggcggcggccuggugcagcccggcggcagccugagacugagcugcgccgccagcggcuucaccuucagcagcuucagcaugagcugggugagacaggcccccggcaagggccuggagugggugagcagcaucagcggcagcagcggcaccaccuacuacgccgacagcgugaagggcagauucaccaucagcagagacaacagcaagaacacccuguaccugcagaugaacagccugagagccgaggacaccgccguguacuacugcgccaagcccuuccccuacuucgacuacuggggccagggcacccuggugaccgugagcagcggcgacggcagcagcggcggcagcggcggcgccagcgagaucgugcugacccagagccccggcacccugagccugagccccggcgagagagccacccugagcugcagagccagccagagcgugagcagcagcuuccuggccugguaccagcagaagcccggccaggcccccagacugcugaucuacuacgccagcagcagagccaccggcauccccgacagauucagcggcagcggcagcggcaccgacuucacccugaccaucagcagacuggagcccgaggacuucgccguguacuacugccagcagaccggcagaaucccccccaccuucggccagggcaccaagguggagaucaagagcggcggcagcggcggccccagagccgcccccgagguguacgccuucgccacccccgaguggcccggcagcagagacaagagaacccuggccugccugauccagaacuucaugcccgaggacaucagcgugcaguggcugcacaacgaggugcagcugcccgacgccagacacagcaccacccagcccagaaagaccaagggcagcggcuucuucguguucagcagacuggaggugaccagagccgagugggagcagaaggacgaguucaucugcagagccgugcacgaggccgccagccccagccagaccgugcagagagccgugagcgugaaccccgagagcagcagaagaggcggcugc

SEQ ID NO: 31286 - RNA, 414 nt, Artificial Sequence; identical to SEQ ID NO: 31237
  derived and/or modified sequence opt4 from Radretumab_j_chain

SEQ ID NO: 31287 - RNA, 1368 nt, Artificial Sequence
  derived and/or modified sequence opt4 from Rafivirumab_HeavyChain1
caggugcagcuggugcagagcggcgccgaggugaagaagcccggcagcagcgugaaggugagcugcaaggccagcggcggcaccuucaacagauacaccgugaacugggugagacaggcccccggccagggccuggaguggaugggcggcaucauccccaucuucggcaccgccaacuacgcccagagauuccagggcagacugaccaucaccgccgacgagagcaccagcaccgccuacauggagcugagcagccugagaagcgacgacaccgccguguacuucugcgccagagagaaccuggacaacagcggcaccuacuacuacuucagcggcugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31288 - RNA, 1368 nt, Artificial Sequence
  derived and/or modified sequence opt4 from Rafivirumab_HeavyChain
gaggugcagcuggugcagagcggcgccgaggugaagaagcccggcagcagcgugaaggugagcugcaaggccagcggcggcaccuucaacagauacaccgugaacugggugagacaggcccccggccagggccuggaguggaugggcggcaucauccccaucuucggcaccgccaacuacgcccagagauuccagggcagacugaccaucaccgccgacgagagcaccagcaccgccuacauggagcugagcagccugagaagcgacgacaccgccguguacuucugcgccagagagaaccuggacaacagcggcaccuacuacuacuucagcggcugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31289 - RNA, 654 nt, Artificial Sequence
  derived and/or modified sequence opt4 from Rafivirumab_LightChain1
cagagcgcccugacccagcccagaagcgugagcggcagccccggccagagcgugaccaucagcugcaccggcaccagcagcgacaucggcggcuacaacuucgugagcugguaccagcagcaccccggcaaggcccccaagcugaugaucuacgacgccaccaagagacccagcggcgugcccgacagauucagcggcagcaagagcggcaacaccgccagccugaccaucagcggccugcaggccgaggacgaggccgacuacuacugcugcagcuacgccggcgacuacacccccggcgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31290 - RNA, 654 nt, Artificial Sequence
  derived and/or modified sequence opt4 from Rafivirumab_LightChain
gagagcgcccugacccagcccagaagcgugagcggcagccccggccagagcgugaccaucagcugcaccggcaccagcagcgacaucggcggcuacaacuucgugagcugguaccagcagcaccccggcaaggcccccaagcugaugaucuacgacgccaccaagagacccagcggcgugcccgacagauucagcggcagcaagagcggcaacaccgccagccugaccaucagcggccugcaggccgaggacgaggccgacuacuacugcugcagcuacgccggcgacuacacccccggcgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31291 - RNA, 1332 nt, Artificial Sequence
  derived and/or modified sequence opt4 from Ralpancizumab_HeavyChain1
caggugcagcuggugcagagcggcgccgaggugaagaagcccggcgccagcgugaaggugagcugcaaggccagcggcuacaccuucaccagcuacuacaugcacugggugagacaggcccccggccagggccuggaguggaugggcgagauccaccccagcggcggcagaaccaacuacaacgagaaguucaagagcagagugaccaugaccagagacaccagcaccagcaccguguacauggagcugagcagccugagaagcgaggacaccgccguguacuacugcgccagagagagaccccuguacgccagcgaccuguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccagcagcaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31292 - RNA, 642 nt, Artificial Sequence
  derived and/or modified sequence opt4 from Ralpancizumab_LightChain1
gacauccagaugacccagagccccagcagccugagcgccagcgugggcgacagagugaccaucaccugcaaggccagccaggacgugcacaccgccguggccugguaccagcagaagcccggcaaggcccccaagcugcugaucuaccacgccagcuacagauacaccggcgugcccagcagauucagcggcagcggcagcggcaccgacuucaccuucaccaucagcagccugcagcccgaggacaucgccaccuacuacugccagcagagauacagccuguggagaaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31293 - RNA, 1338 nt, Artificial Sequence
  derived and/or modified sequence opt4 from Ramucirumab_HeavyChain1
gaggugcagcuggugcagagcggcggcggccuggugaagcccggcggcagccugagacugagcugcgccgccagcggcuucaccuucagcagcuacagcaugaacugggugagacaggcccccggcaagggccuggagugggugagcagcaucagcagcagcagcagcuacaucuacuacgccgacagcgugaagggcagauucaccaucagcagagacaacgccaagaacagccuguaccugcagaugaacagccugagagccgaggacaccgccguguacuacugcgccagagugaccgacgccuucgacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31294 - RNA, 642 nt, Artificial Sequence
  derived and/or modified sequence opt4 from Ramucirumab_LightChain1
gacauccagaugacccagagccccagcagcgugagcgccagcaucggcgacagagugaccaucaccugcagagccagccagggcaucgacaacuggcugggcugguaccagcagaagcccggcaaggcccccaagcugcugaucuacgacgccagcaaccuggacaccggcgugcccagcagauucagcggcagcggcagcggcaccuacuucacccugaccaucagcagccugcaggccgaggacuucgccguguacuucugccagcaggccaaggccuucccccccaccuucggcggcggcaccaagguggacaucaagggcaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31295 - RNA, 687 nt, Artificial Sequence
  derived and/or modified sequence opt4 from Ranibiziuab_HeavyChain1
gaggugcagcugguggagagcggcggcggccuggugcagcccggcggcagccugagacugagcugcgccgccagcggcuacgacuucacccacuacggcaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaacagccugagagccgaggacaccgccguguacuacugcgccaaguaccccuacuacuacggcaccagccacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccaccug

SEQ ID NO: 31296 - RNA, 642 nt, Artificial Sequence
  derived and/or modified sequence opt4 from Ranibiziuab_LightChain1
gacauccagcugacccagagccccagcagccugagcgccagcgugggcgacagagugaccaucaccugcagcgccagccaggacaucagcaacuaccugaacugguaccagcagaagcccggcaaggcccccaaggugcugaucuacuucaccagcagccugcacagcggcgugcccagcagauucagcggcagcggcagcggcaccgacuucacccugaccaucagcagccugcagcccgaggacuucgccaccuacuacugccagcaguacagcaccgugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31297 - RNA, 639 nt, Artificial Sequence
  derived and/or modified sequence opt4 from Ranibizumab_fab_fragment
gacauccagcugacccagagccccagcagccugagcgccagcgugggcgacagagugaccaucaccugcagcgccagccaggacaucagcaacuaccugaacugguaccagcagaagcccggcaaggcccccaaggugcugaucuacuucaccagcagccugcacagcggcgugcccagcagauucagcggcagcggcagcggcaccgacuucacccugaccaucagcagccugcagcccgaggacuucgccaccuacuacugccagcaguacagcaccgugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgag

SEQ ID NO: 31298 - RNA, 693 nt, Artificial Sequence
  derived and/or modified sequence opt4 from Ranibizumab_HeavyChain
gaggugcagcugguggagagcggcggcggccuggugcagcccggcggcagccugagacugagcugcgccgccagcggcuacgacuucacccacuacggcaugaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaugaacagccugagagccgaggacaccgccguguacuacugcgccaaguaccccuacuacuacggcaccagccacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccaccug

SEQ ID NO: 31299 - RNA, 654 nt, Artificial Sequence
  derived and/or modified sequence opt4 from Ranibizumab_LightChain
gaggugcagcugguggagagcggcggcggccuggugcagcccggcggcagccugagacugagcugcgccgccagcggcuacgacuucacccacuacggcaugaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaugaacagccugagagccgaggacaccgccguguacuacugcgccaaguaccccuacuacuacggcaccagccacugguacuucgacguguggggccagggcacccuggugaccgugagcagcgccagcaccaagggccccagcguguucccccuggcccccagcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaag

SEQ ID NO: 31300 - RNA, 642 nt, Artificial Sequence; identical to SEQ ID NO: 31296
  derived and/or modified sequence opt4 from Ranibizumab_LightChain_variant

SEQ ID NO: 31301 - RNA, 1368 nt, Artificial Sequence
  derived and/or modified sequence opt4 from Refanezumab_HeavyChain1
caggugcagcuggugcagagcggcagcgagcugaagaagcccggcgccagcgugaaggugagcugcaaggccagcggcuacaccuucaccaacuacggcaugaacugggugagacaggcccccggccagggccuggaguggaugggcuggaucaacaccuacaccggcgagcccaccuacgccgacgacuucaccggcagauucguguucagccuggacaccagcgugagcaccgccuaccugcagaucagcagccugaaggccgaggacaccgccguguacuacugcgccagaaaccccaucaacuacuacggcaucaacuacgagggcuacgugauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcuggccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31302 - RNA, 657 nt, Artificial Sequence
  derived and/or modified sequence opt4 from Refanezumab_LightChain1
gacaucgugaugacccagagccccgacagccuggccgugagccugggcgagagagccaccaucaacugcaagagcagccacagcgugcuguacagcagcaaccagaagaacuaccuggccugguaccagcagaagcccggccagccccccaagcugcugaucuacugggccagcaccagagagagcggcgugcccgacagauucagcggcagcggcagcggcaccgacuucacccugaccaucagcagccugcaggccgaggacguggccguguacuacugccaccaguaccugagcagccugaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31303 - RNA, 1314 nt, Artificial Sequence
  derived and/or modified sequence opt4 from REGN2810_HeavyChain1
gaggugcagcugcuggagagcggcggcgugcuggugcagcccggcggcagccugagacugagcugcgccgccagcggcuucaccuucagcaacuucggcaccugggugagacaggcccccggcaagggccuggagugggugagcggcaucagcggcggcggcagagacaccuacuucgccgacagcgugaagggcagauucaccaucagcagagacaacagcaagaacacccuguaccugcagaacagccugaagggcgaggacaccgccguguacuacugcgugaaguggggcaacaucuacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugcacgaggcccugcacaaccacuacacccagaagagccugagccugagccugggc

SEQ ID NO: 31304 - RNA, 639 nt, Artificial Sequence
  derived and/or modified sequence opt4 from REGN2810_LightChain1
gacauccagacccagagccccagcagccugagcgccagcgugggcgacagcaucaccaucaccugcagagccagccugagcaucaacaccuuccugaacugguaccagcagaagcccggcaaggcccccaaccugcugaucuacgccgccagcagccugcacggcggcgugcccagcagauucagcggcagcggcagcggcaccgacuucacccugaccaucagaacccugcagcccgaggacuucgccaccuacuacugccagcagagcagcaacacccccuucaccuucggccccggcaccgugguggacuucagaagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31305 - RNA, 651 nt, Artificial Sequence
  derived and/or modified sequence opt4 from rhuMab_HER2(9CI)_LightChain
gugcacagcgacauccagaugacccagagccccagcagccugagcgccagcgugggcgacagagugaccaucaccugcaaggccagccaggacgugagcaucggcguggccugguaccagcagaagcccggcaaggcccccaagcugcugaucuacagcgccagcuacagauacaccggcgugcccagcagauucagcggcagcggcagcggcaccgacuucacccugaccaucagcagccugcagcccgaggacuucgccaccuacuacugccagcaguacuacaucuaccccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31306 - RNA, 1215 nt, Artificial Sequence
  derived and/or modified sequence opt4 from rhuMab_HER2_HeavyChain
gaggugcagcugguggagagcggcggcggccuggugcagcccggcggcagccugagacugagcugcgccgccagcggcuucaccuucaccgacuacaccauggacugggugagacaggcccccggcaagggccugaccgccguguacuacugcgccagaaaccugggccccagcuucuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggccccaag

SEQ ID NO: 31307 - RNA, 645 nt, Artificial Sequence
  derived and/or modified sequence opt4 from rhuMab_HER2_LightChain
agcgacauccagaugacccagagccccagcagccugagcgccagcgugggcgacagagugaccaucaccugcagagccagccaggacgugaacaccgccguggccugguaccagcagaagcccggcaaggcccccaagcugcugaucuacagcgccagcuuccuguacagcggcgugcccagcagauucagcggcagcagaagcggcaccgacuucacccugaccaucagcagccugcagcccgaggacuucgccaccuacuacugccagcagcacuacaccaccccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31308 - RNA, 318 nt, Artificial Sequence
  derived and/or modified sequence opt4 from rhuMab_HER2_LightChain_variant1
accguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31309 - RNA, 642 nt, Artificial Sequence
  derived and/or modified sequence opt4 from rhuMab_HER2_LightChain_variant2
gacauccagaugacccagagccccagcagccugagcgccagcgugggcgacagagugaccaucaccugcagagccagccaggacgugaacaccgccguggccugguaccagcagaagcccggcaaggcccccaagcugcugaucuacagcgccagcuuccuguacagcggcgugcccagcagauucagcggcagcagaagcggcaccgacuucacccugaccaucagcagccugcagcccgaggacuucgccaccuacuacugccagcagcacuacaccaccccccccaccuucggccagggcaccaagguggagaucaagagaaccugcgccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31310 - RNA, 642 nt, Artificial Sequence
  derived and/or modified sequence opt4 from rhuMab_HER2_LightChain_variant3
gacauccagaugacccagagccccagcagccugagcgccagcgugggcgacagagugaccaucaccugcagagccagccaggacgugaacaccgccguggccugguaccagcagaagcccggcaaggcccccaagcugcugaucuacagcgccagcuuccuguacagcggcgugcccagcagauucagcggcagcagaagcggcaccgacuucacccugaccaucagcagccugcagcccgaggacuucgccaccuacuacugccagcagcacuacaccaccccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31311 - RNA, 645 nt, Artificial Sequence; identical to SEQ ID NO: 31307
  derived and/or modified sequence opt4 from rhuMab_HER2_LightChain_variant4

SEQ ID NO: 31312 - RNA, 321 nt, Artificial Sequence
  derived and/or modified sequence opt4 from rhuMab_HER2_LightChain_V-Region
gacauccagaugacccagagccccagcagccugagcgccagcgugggcgacagagugaccaucaccugcagagccagccaggacgugaacaccgccguggccugguaccagcagaagcccggcaaggcccccaagcugcugaucuacagcgccagcuuccuguacagcggcgugcccagcagauucagcggcagcagaagcggcaccgacuucacccugaccaucagcagccugcagcccgaggacuucgccaccuacuacugccagcagcacuacaccaccccccccaccuucggccagggcaccaagguggagaucaag

SEQ ID NO: 31313 - RNA, 1350 nt, Artificial Sequence
  derived and/or modified sequence opt4 from rhuMab_HER2_gamma1-Chain
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaugaacagccugagagccgaggacaccgccguguacuacugcagcagauggggcggcgacggcuucuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31314 - RNA, 1350 nt, Artificial Sequence
  derived and/or modified sequence opt4 from rhuMab_HER2__gamma1-Chain
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaugaacagccugagagccgaggacaccgccguguacuacugcagcagauggggcggcgacggcuucuacgccauggacuacuggggccagggcacccuggugaccgugagcagcugcagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31315 - RNA, 729 nt, Artificial Sequence
  derived and/or modified sequence opt4 from rhuMab_HER2_gamma1-Chain__rhuMab_HER2_LightChain_sc4D5
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaugaacagccugagagccgaggacaccgccguguacuacugcagcagauggggcggcgacggcuucuacgccauggacuacuggggccagggcacccuggugaccgugagcagcggcggcggcggcagcggcggcggcggcagcggcggcggcggcagcgacauccagaugacccagagccccagcagccugagcgccagcgugggcgacagagugaccaucaccugcagagccagccaggacgugaacaccgccguggccugguaccagcagaagcccggcaaggcccccaagcugcugaucuacagcgccagcuuccuguacagcggcgugcccagcagauucagcggcagcagaagcggcaccgacuucacccugaccaucagcagccugcagcccgaggacuucgccaccuacuacugccagcagcacuacaccaccccccccaccuucggccagggcaccaagguggagaucaagaga

SEQ ID NO: 31316 - RNA, 1350 nt, Artificial Sequence; identical to SEQ ID NO: 31313
  derived and/or modified sequence opt4 from rhuMab_HER2_gamma1-Chain_variant1

SEQ ID NO: 31317 - RNA, 1350 nt, Artificial Sequence; identical to SEQ ID NO: 31314
  derived and/or modified sequence opt4 from rhuMab_HER2_gamma1-Chain_variant2

SEQ ID NO: 31318 - RNA, 1350 nt, Artificial Sequence
  derived and/or modified sequence opt4 from rhuMab_HER2_gamma1-Chain_variant3
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaugaacagccugagaugcgaggacaccgccguguacuacugcagcagauggggcggcgacggcuucuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31319 - RNA, 360 nt, Artificial Sequence
  derived and/or modified sequence opt4 from rhuMab_HER2_gamma1-Chain_V-Region
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaugaacagccugagagccgaggacaccgccguguacuacugcagcagauggggcggcgacggcuucuacgccauggacuacuggggccagggcacccuggugaccgugagcagc

SEQ ID NO: 31320 - RNA, 1359 nt, Artificial Sequence; identical to SEQ ID NO: 30651
  derived and/or modified sequence opt4 from rhuMAb-VEGF_HeavyChain1

SEQ ID NO: 31321 - RNA, 642 nt, Artificial Sequence; identical to SEQ ID NO: 30652
  derived and/or modified sequence opt4 from rhuMAb-VEGF_LightChain1

SEQ ID NO: 31322 - RNA, 642 nt, Artificial Sequence; identical to SEQ ID NO: 30652
  derived and/or modified sequence opt4 from rhuMAb-VEGF_LightChain

SEQ ID NO: 31323 - RNA, 321 nt, Artificial Sequence; identical to SEQ ID NO: 30661
  derived and/or modified sequence opt4 from rhuMAb-VEGF_LightChain__VG-Region

SEQ ID NO: 31324 - RNA, 1359 nt, Artificial Sequence; identical to SEQ ID NO: 30651
  derived and/or modified sequence opt4 from rhuMAb-VEGF_gamma1-Chain

SEQ ID NO: 31325 - RNA, 369 nt, Artificial Sequence; identical to SEQ ID NO: 30656
  derived and/or modified sequence opt4 from rhuMAb-VEGF_gamma1-Chain_VDG-Region

SEQ ID NO: 31326 - RNA, 1338 nt, Artificial Sequence
  derived and/or modified sequence opt4 from Rilotumumab_HeavyChain1
caggugcagcugcaggagagcggccccggccuggugaagcccagcgagacccugagccugaccugcaccgugagcggcggcagcaucagcaucuacuacuggagcuggaucagacagccccccggcaagggccuggaguggaucggcuacguguacuacagcggcagcaccaacuacaaccccagccugaagagcagagugaccaucagcguggacaccagcaagaaccaguucagccugaagcugaacagcgugaccgccgccgacaccgccguguacuacugcgccagaggcggcuacgacuucuggagcggcuacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31327 - RNA, 645 nt, Artificial Sequence
  derived and/or modified sequence opt4 from Rilotumumab_LightChain1
gagaucgugaugacccagagccccgccacccugagcgugagccccggcgagagagccacccugagcugcagagccagccagagcguggacagcaaccuggccugguacagacagaagcccggccaggcccccagacugcugaucuacggcgccagcaccagagccaccggcauccccgccagauucagcggcagcggcagcggcaccgaguucacccugaccaucagcagccugcagagcgaggacuucgccguguacuacugccagcaguacaucaacuggccccccaucaccuucggccagggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31328 - RNA, 1071 nt, Artificial Sequence; identical to SEQ ID NO: 31285
  derived and/or modified sequence opt4 from Rilotumumab_scFv-CH_chain

SEQ ID NO: 31329 - RNA, 1347 nt, Artificial Sequence
  derived and/or modified sequence opt4 from Rinucumab_HeavyChain1
cagcugcagcugcaggagagcggccccggccuggugaagcccagcgagacccugagccugaccugcaccgugagcggcggcagcaucaccagcagcagcuacuacuggggcuggaucagacagccccccggcaagggccuggaguggaucggcagcaucuacuacagaggcagcaccaacuacaaccccagccugaagagcagagugaccaucagcguggacagcagcaagaaccaguucuaccugaaggugagcagcgugaccgccguggacaccgccguguacuacugcgccagacagaacggcgccgccagacccagcugguucgaccccuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31330 - RNA, 1344 nt, Artificial Sequence
  derived and/or modified sequence opt4 from Rinucumab_HeavyChain
cagcugcagcugcaggagagcggccccggccuggugaagcccagcgagacccugagccugaccugcaccgugagcggcggcagcaucaccagcagcagcuacuacuggggcuggaucagacagccccccggcaagggccuggaguggaucggcagcaucuacuacagaggcagcaccaacuacaaccccagccugaagagcagagugaccaucagcguggacagcagcaagaaccaguucuaccugaaggugagcagcgugaccgccguggacaccgccguguacuacugcgccagacagaacggcgccgccagacccagcugguucgaccccuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 31331 - RNA, 645 nt, Artificial Sequence
  derived and/or modified sequence opt4 from Rinucumab_LightChain1
gagaucgugcugacccagagccccgacaccaucagccugagccccggcgagagagccacccugagcugcagagccagccagagcaucagcagcaucuaccuggccugguaccagcagaagcccggccaggcccccagacugcugaucuacggcgccagcagcagagugaccggcauccccgacagauucagcgugagcggcagcggcaccgacuucacccugaccaucagcagacuggagcccgaggacuucgccguguacuacugccagcacuacggcaucagccccuucaccuucggccccggcaccaagguggacaucagaagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31332 - RNA, 1347 nt, Artificial Sequence
  derived and/or modified sequence opt4 from Risankizumab_HeavyChain1
caggugcagcuggugcagagcggcgccgaggugaagaagcccggcagcagcgugaaggugagcugcaaggccagcggcuacaccuucaccgaccagaccauccacuggaugagacaggcccccggccagggccuggaguggaucggcuacaucuaccccagagacgacagccccaaguacaacgagaacuucaagggcaaggugaccaucaccgccgacaagagcaccagcaccgccuacauggagcugagcagccugagaagcgaggacaccgccguguacuacugcgccauccccgacagaagcggcuacgccugguucaucuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31333 - RNA, 642 nt, Artificial Sequence
  derived and/or modified sequence opt4 from Risankizumab_LightChain1
gacauccagaugacccagagccccagcagccugagcgccagcgugggcgacagagugaccaucaccugcaaggccagcagagacguggccaucgccguggccugguaccagcagaagcccggcaaggugcccaagcugcugaucuacugggccagcaccagacacaccggcgugcccagcagauucagcggcagcggcagcagaaccgacuucacccugaccaucagcagccugcagcccgaggacguggccgacuacuucugccaccaguacagcagcuaccccuucaccuucggcagcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31334 - RNA, 1353 nt, Artificial Sequence
  derived and/or modified sequence opt4 from Rituximab_HeavyChain
caggugcagcugcagcagcccggcgccgagcuggugaagcccggcgccagcgugaagaugagcugcaaggccagcggcuacaccuucaccagcuacaacaugcacugggugaagcagacccccggcagaggccuggaguggaucggcgccaucuaccccggcaacggcgacaccagcuacaaccagaaguucaagggcaaggccacccugaccgccgacaagagcagcagcaccgccuacaugcagcugagcagccugaccagcgaggacagcgccguguacuacugcgccagaagcaccuacuacggcggcgacugguacuucaacguguggggcgccggcaccaccgugaccgugagcgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31335 - RNA, 1353 nt, Artificial Sequence
  derived and/or modified sequence opt4 from Rituximab_HeavyChain_variant
caggugcagcugcagcagcccggcgccgagcuggugaagcccggcgccagcgugaagaugagcugcaaggccagcggcuacaccuucaccagcuacaacaugcacugggugaagcagacccccggcagaggccuggaguggaucggcgccaucuaccccggcaacggcgacaccagcuacaaccagaaguucaagggcaaggccacccugaccgccgacaagagcagcagcaccgccuacaugcagcugagcagccugaccagcgaggacagcgccguguacuacugcgccagaagcaccuacuacggcggcgacugguacuucaacguguggggcgccggcaccaccgugaccgugagcgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggccgagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31336 - RNA, 639 nt, Artificial Sequence
  derived and/or modified sequence opt4 from Rituximab_LightChain
cagaucgugcugagccagagccccgccauccugagcgccagccccggcgagaaggugaccaugaccugcagagccagcagcagcgugagcuacauccacugguuccagcagaagcccggcagcagccccaagcccuggaucuacgccaccagcaaccuggccagcggcgugcccgugagauucagcggcagcggcagcggcaccagcuacagccugaccaucagcagaguggaggccgaggacgccgccaccuacuacugccagcaguggaccagcaacccccccaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31337 - RNA, 714 nt, Artificial Sequence
  derived and/or modified sequence opt4 from Rivabazumab_pegol_HeavyChain1
gaggugcagcugguggagagcggcggcggcguggugcagcccggcagaagccugagacugagcugcgccgccagcggcuucaccuucagcaacuaccccaugcacugggugagacaggcccccggcaagggccuggaguggguggccgugaucagcuacgacggcagcgagaagugguacgccgacagcgugaagggcagauucaccaucagcagagacaacagcaagaacacccuguaccuggagaugaacagccugagacccgaggacaccgccguguacuacugcgccagaaacagaggcgacaucuacuacgacuucaccuacgccauggacaucuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcagcgacaagacccacaccugcccccccugccccgcc

SEQ ID NO: 31338 - RNA, 642 nt, Artificial Sequence
  derived and/or modified sequence opt4 from Rivabazumab_pegol_LightChain1
gacauccagcugacccagagccccagcacccugagcgccagcgugggcgacagcgugaccaucaccugcagagccagcgagggcguggacagauggcuggccugguaccagcagaagcccggcagagcccccaagcugcugaucuacgacgccagcacccugcagagcggcgugcccagcagauucagcggcagcggcagcggcaccgaguucagccugaccaucagcagccugcagcccgacgacguggccaccuacuacugccagcacuucuggggcacccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagagc

SEQ ID NO: 31339 - RNA, 1344 nt, Artificial Sequence
  derived and/or modified sequence opt4 from Robatumumab_HeavyChain1
gaggugcagcuggugcagagcggcggcggccuggugaagcccggcggcagccugagacugagcugcgccgccagcggcuucaccuucagcagcuucgccaugcacugggugagacaggcccccggcaagggccuggaguggaucagcgugaucgacaccagaggcgccaccuacuacgccgacagcgugaagggcagauucaccaucagcagagacaacgccaagaacagccuguaccugcagaugaacagccugagagccgaggacaccgccguguacuacugcgccagacugggcaacuucuacuacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31340 - RNA, 642 nt, Artificial Sequence
  derived and/or modified sequence opt4 from Robatumumab_LightChain1
gagaucgugcugacccagagccccggcacccugagcgugagccccggcgagagagccacccugagcugcagagccagccagagcaucggcagcagccugcacugguaccagcagaagcccggccaggcccccagacugcugaucaaguacgccagccagagccugagcggcauccccgacagauucagcggcagcggcagcggcaccgacuucacccugaccaucagcagacuggagcccgaggacuucgccguguacuacugccaccagagcagcagacugccccacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31341 - RNA, 1368 nt, Artificial Sequence
  derived and/or modified sequence opt4 from Roledumab_HeavyChain1
caggugcagcugguggagagcggcggcggcguggugcagcccggcagaagccugagacugagcugcaccgccagcggcuucaccuucaagaacuacgccaugcacugggugagacaggcccccgccaagggccuggaguggguggccaccaucagcuacgacggcagaaacauccaguacgccgacagcgugaagggcagauucaccuucagcagagacaacagccaggacacccuguaccugcagcugaacagccugagacccgaggacaccgccguguacuacugcgccagacccgugagaagcagauggcugcagcugggccuggaggacgccuuccacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31342 - RNA, 642 nt, Artificial Sequence
  derived and/or modified sequence opt4 from Roledumab_LightChain1
gccaucagaaugacccagagccccagcagcuucagcgccagcaccggcgacagagugaccaucaccugcagagccagccaggacaucagaaacuacguggccugguaccagcagaagagcggcaaggcccccaaguuccugaucuacgccgccagcacccugcagagcggcgugcccagcagauucagcggcagcggcagcggcaccgacuucacccugaccaucaacagccugcagagcgaggacuucgccaccuacuacugccagcaguacuacaacagcccccccaccuucggccagggcaccagaguggagaucaccagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31343 - RNA, 639 nt, Artificial Sequence; identical to SEQ ID NO: 31297
  derived and/or modified sequence opt4 from Romosozumab_fab_fragment

SEQ ID NO: 31344 - RNA, 1347 nt, Artificial Sequence
  derived and/or modified sequence opt4 from Romosozumab_HeavyChain1
gaggugcagcuggugcagagcggcgccgaggugaagaagcccggcgccagcgugaaggugagcugcaaggccagcggcuacaccuucaccgacuacaacaugcacugggugagacaggcccccggccagggccuggaguggaugggcgagaucaaccccaacagcggcggcgccggcuacaaccagaaguucaagggcagagugaccaugaccaccgacaccagcaccagcaccgccuacauggagcugagaagccugagaagcgacgacaccgccguguacuacugcgccagacugggcuacgacgacaucuacgacgacugguacuucgacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31345 - RNA, 642 nt, Artificial Sequence
  derived and/or modified sequence opt4 from Romosozumab_LightChain1
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcagacugcugagcggcgugcccagcagauucagcggcagcggcagcggcaccgacuucacccugaccaucagcagccugcagcccgaggacuucgccaccuacuacugccagcagggcgacacccugcccuacaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31346 - RNA, 1326 nt, Artificial Sequence
  derived and/or modified sequence opt4 from Rontalizuab_HeavyChain1
gaggugcagcugguggagagcggcggcggccuggugcagcccggcggcagccugagacugagcugcgccaccagcggcuacaccuucaccgaguacaucauccacugggugagacaggcccccggcaagggccuggaguggguggccagcaucaaccccgacuacgacaucaccaacuacaaccagagauucaagggcagauucaccaucagccuggacaagagcaagagaaccgccuaccugcagaacagccugagagccgaggacaccgccguguacuacugcgccagcuggaucagcgacuucuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggc

SEQ ID NO: 31347 - RNA, 648 nt, Artificial Sequence
  derived and/or modified sequence opt4 from Rontalizuab_LightChain1
gacauccagacccagagccccagcagccugagcgccagcgugggcgacagagugaccaucaccugcagagccagccagagcgugagcaccagcagcuacagcuaccacugguaccagcagaagcccggcaaggcccccaaggugcugaucagcuacgccagcaaccuggagagcggcgugcccagcagauucagcggcagcggcagcggcaccgacuucacccugaccaucagcagccugcagcccgaggacuucgccaccuacuacugccagcacagcuggggcauccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31348 - RNA, 1341 nt, Artificial Sequence
  derived and/or modified sequence opt4 from Rontalizumab_HeavyChain1
gaggugcagcugguggagagcggcggcggccuggugcagcccggcggcagccugagacugagcugcgccaccagcggcuacaccuucaccgaguacaucauccacugggugagacaggcccccggcaagggccuggaguggguggccagcaucaaccccgacuacgacaucaccaacuacaaccagagauucaagggcagauucaccaucagccuggacaagagcaagagaaccgccuaccugcagaugaacagccugagagccgaggacaccgccguguacuacugcgccagcuggaucagcgacuucuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31349 - RNA, 654 nt, Artificial Sequence
  derived and/or modified sequence opt4 from Rontalizumab_LightChain1
gacauccagaugacccagagccccagcagccugagcgccagcgugggcgacagagugaccaucaccugcagagccagccagagcgugagcaccagcagcuacagcuacaugcacugguaccagcagaagcccggcaaggcccccaaggugcugaucagcuacgccagcaaccuggagagcggcgugcccagcagauucagcggcagcggcagcggcaccgacuucacccugaccaucagcagccugcagcccgaggacuucgccaccuacuacugccagcacagcuggggcauccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31350 - RNA, 1341 nt, Artificial Sequence
  derived and/or modified sequence opt4 from Rovalpituzumab_tesirine_HeavyChain1
caggugcagcuggugcagagcggcgccgaggugaagaagcccggcgccagcgugaaggugagcugcaaggccagcggcuacaccuucaccaacuacggcaugaacugggugagacaggcccccggccagggccuggaguggaugggcuggaucaacaccuacaccggcgagcccaccuacgccgacgacuucaagggcagagugaccaugaccaccgacaccagcaccagcaccgccuacauggagcugagaagccugagaagcgacgacaccgccguguacuacugcgccagaaucggcgacagcagccccagcgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31351 - RNA, 642 nt, Artificial Sequence
  derived and/or modified sequence opt4 from Rovalpituzumab_tesirine_LightChain1
gagaucgugaugacccagagccccgccacccugagcgugagccccggcgagagagccacccugagcugcaaggccagccagagcgugagcaacgacguggugugguaccagcagaagcccggccaggcccccagacugcugaucuacuacgccagcaacagauacaccggcauccccgccagauucagcggcagcggcagcggcaccgaguucacccugaccaucagcagccugcagagcgaggacuucgccguguacuacugccagcaggacuacaccagccccuggaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31352 - RNA, 1341 nt, Artificial Sequence
  derived and/or modified sequence opt4 from Rovelizumab_HeavyChain1
caggugcagcuggugcagagcggcgccgaggugaagaagcccggcgccagcgugaaggugagcugcaaggccagcggcuacaccuucaccaacaacuggaugcagugggugagacaggcccccggccagggccuggaguggaugggcgccaucuuccccggcgacgacgagaccagauacacccagaaguucagaggcaaggccaccaucaccgccgacaccagcaccagcaccgccuacauggagcugagcagccugagaagcgaggacaccgccguguacuacugcggcagaggcggcaagcugagacccuucgcccuggacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31353 - RNA, 654 nt, Artificial Sequence
  derived and/or modified sequence opt4 from Rovelizumab_LightChain1
gacauccagaugacccagagccccagcagccugagcgccagcgugggcgacagagugaccaucaccugcagagccagcgagagcguggagagcuacggcaacaacuucauguacugguaccagcagaagcccggcaaggcccccaagcugcugaucuaccuggccagcaaccuggagagcggcgugcccagcagauucagcggcagcggcagcggcaccgacuucacccugaccaucagcagccugcagcccgaggacuucgccaccuacuacugccaccaggacaacgaggacccccccaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31354 - RNA, 1341 nt, Artificial Sequence
  derived and/or modified sequence opt4 from Ruplizumab_HeavyChain1
caggugcagcuggugcagagcggcgccgagguggugaagcccggcgccagcgugaagcugagcugcaaggccagcggcuacaucuucaccagcuacuacauguacugggugaagcaggcccccggccagggccuggaguggaucggcgagaucaaccccagcaacggcgacaccaacuucaacgagaaguucaagagcaaggccacccugaccguggacaagagcgccagcaccgccuacauggagcugagcagccugagaagcgaggacaccgccguguacuacugcaccagaagcgacggcagaaacgacauggacagcuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31355 - RNA, 654 nt, Artificial Sequence
  derived and/or modified sequence opt4 from Ruplizumab_LightChain1
gacaucgugcugacccagagccccgccacccugagcgugagccccggcgagagagccaccaucagcugcagagccagccagagagugagcagcagcaccuacagcuacaugcacugguaccagcagaagcccggccagccccccaagcugcugaucaaguacgccagcaaccuggagagcggcgugcccgccagauucagcggcagcggcagcggcaccgacuucacccugaccaucagcagcguggagcccgaggacuucgccaccuacuacugccagcacagcugggagaucccccccaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31356 - RNA, 1353 nt, Artificial Sequence
  derived and/or modified sequence opt4 from Sacituzumab_govitecan_HeavyChain1
caggugcagcugcagcagagcggcagcgagcugaagaagcccggcgccagcgugaaggugagcugcaaggccagcggcuacaccuucaccaacuacggcaugaacugggugaagcaggcccccggccagggccugaaguggaugggcuggaucaacaccuacaccggcgagcccaccuacaccgacgacuucaagggcagauucgccuucagccuggacaccagcgugagcaccgccuaccugcagaucagcagccugaaggccgacgacaccgccguguacuucugcgccagaggcggcuucggcagcagcuacugguacuucgacguguggggccagggcagccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31357 - RNA, 642 nt, Artificial Sequence
  derived and/or modified sequence opt4 from Sacituzumab_govitecan_LightChain1
gacauccagcugacccagagccccagcagccugagcgccagcgugggcgacagagugagcaucaccugcaaggccagccaggacgugagcaucgccguggccugguaccagcagaagcccggcaaggcccccaagcugcugaucuacagcgccagcuacagauacaccggcgugcccgacagauucagcggcagcggcagcggcaccgacuucacccugaccaucagcagccugcagcccgaggacuucgccguguacuacugccagcagcacuacaucaccccccugaccuucggcgccggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31358 - RNA, 1326 nt, Artificial Sequence
  derived and/or modified sequence opt4 from Samalizumab_HeavyChain1
caggugcagcugcagcagagcggcagcgagcugaagaagcccggcgccagcgugaagaucagcugcaaggccagcggcuacagcuucaccgacuacaucauccugugggugagacagaaccccggcaagggccuggaguggaucggccacaucgaccccuacuacggcagcagcaacuacaaccugaaguucaagggcagagugaccaucaccgccgaccagagcaccaccaccgccuacauggagcugagcagccugagaagcgaggacaccgccguguacuacugcggcagaagcaagagagacuacuucgacuacuggggccagggcaccacccugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 31359 - RNA, 642 nt, Artificial Sequence
  derived and/or modified sequence opt4 from Samalizumab_LightChain1
gacauccagaugacccagagccccagcagccugagcgccagcaucggcgacagagugaccaucaccugcaaggccagccaggacaucaacagcuaccugagcugguuccagcagaagcccggcaaggcccccaagcugcugaucuacagagccaacagacugguggacggcgugcccagcagauucagcggcagcggcagcggcaccgacuacacccugaccaucagcagccugcagcccgaggacuucgccguguacuacugccugcaguacgacgaguuccccuacaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31360 - RNA, 1338 nt, Artificial Sequence
  derived and/or modified sequence opt4 from Sarilumab_HeavyChain1
gaggugcagcugguggagagcggcggcggccuggugcagcccggcagaagccugagacugagcugcgccgccagcagauucaccuucgacgacuacgccaugcacugggugagacaggcccccggcaagggccuggagugggugagcggcaucagcuggaacagcggcagaaucggcuacgccgacagcgugaagggcagauucaccaucagcagagacaacgccgagaacagccuguuccugcagaugaacggccugagagccgaggacaccgcccuguacuacugcgccaagggcagagacagcuucgacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31361 - RNA, 642 nt, Artificial Sequence
  derived and/or modified sequence opt4 from Sarilumab_LightChain1
gacauccagaugacccagagccccagcagcgugagcgccagcgugggcgacagagugaccaucaccugcagagccagccagggcaucagcagcuggcuggccugguaccagcagaagcccggcaaggcccccaagcugcugaucuacggcgccagcagccuggagagcggcgugcccagcagauucagcggcagcggcagcggcaccgacuucacccugaccaucagcagccugcagcccgaggacuucgccagcuacuacugccagcaggccaacagcuuccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31362 - RNA, 1296 nt, Artificial Sequence
  derived and/or modified sequence opt4 from Satumomab_pendetide_HeavyChain
caggugcagcugcagcagagcgacgccgagcuggugaagcccggcgccagcgugaagaucagcugcaaggccagcggcuacaccuucaccgaccacgccauccacugggccaagcagaagcccgagcagggccuggaguggaucggcuacaucagccccggcaacgacgacaucaaguacaacgagaaguucaagggcaaggccacccugaccgccgacaagagcagcagcaccgccuacaugcagcugaacagccugaccagcgaggacagcgccguguacuucugcaagagaagcuacuacggccacuggggccagggcaccacccugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagagugugcccccccugcaagugccccgcccccaaccugcugggcggccccagcguguucaucuucccccccaagaucaaggacgugcugaugaucagccugagccccaucgugaccugcguggugguggacgugagcgaggacgaccccgacgugcagaucagcugguucgugaacaacguggaggugcacaccgcccagacccagacccacagagaggacuacaacagcacccugagaguggugagcgcccugcccauccagcaccaggacuggaugagcggcaaggaguucaagugcaaggugaacaacaaggaccugcccgcccccaucgagagaaccaucagcaagcccaagggcagcgugagagccccccagguguacgugcugcccccccccgaggaggagaugaccaagaagcaggugacccugaccugcauggugaccgacuucaugcccgaggacaucuacguggaguggaccaacaacggcaagaccgagcugaacuacaagaacaccgagcccgugcuggacagcgacggcagcuacuucauguacagcaagcugagaguggagaagaagaacuggguggagagaaacagcuacagcugcagcguggugcacgagggccugcacaaccaccacaccaccaagagcuucagcaga

SEQ ID NO: 31363 - RNA, 630 nt, Artificial Sequence
  derived and/or modified sequence opt4 from Satumomab_pendetide_LightChain
gacauccagaugacccagagccccgccagccugagcgugagcgugggcgagaccgugaccaucaccugcagagccagcgagaacaucuacagcaaccuggccugguaccagcagaagcagggcaagagcccccagcugcugguguacgccgccaccaaccuggccgacggcgugcccagcagauucagcggcagcggcagcggcacccaguacagccugaagaucaacagccugcagagcgaggacuucggcagcuacuacugccagcacuucuggggcacccccuacaccuucggcggcggcaccagacuggagaucaagagagccgacgccgcccccaccguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaac

SEQ ID NO: 31364 - RNA, 1371 nt, Artificial Sequence
  derived and/or modified sequence opt4 from Secukinumab_HeavyChain1
gaggugcagcugguggagagcggcggcggccuggugcagcccggcggcagccugagacugagcugcgccgccagcggcuucaccuucagcaacuacuggaugaacugggugagacaggcccccggcaagggccuggaguggguggccgccaucaaccaggacggcagcgagaaguacuacgugggcagcgugaagggcagauucaccaucagcagagacaacgccaagaacagccuguaccugcagaugaacagccugagaguggaggacaccgccguguacuacugcgugagagacuacuacgacauccugaccgacuacuacauccacuacugguacuucgaccuguggggcagaggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31365 - RNA, 645 nt, Artificial Sequence
  derived and/or modified sequence opt4 from Secukinumab_LightChain1
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccccugcaccuucggccagggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31366 - RNA, 1335 nt, Artificial Sequence
  derived and/or modified sequence opt4 from Seribantumab_HeavyChain1
gaggugcagcugcuggagagcggcggcggccuggugcagcccggcggcagccugagacugagcugcgccgccagcggcuucaccuucagccacuacgugauggccugggugagacaggcccccggcaagggccuggagugggugagcagcaucagcagcagcggcggcuggacccuguacgccgacagcgugaagggcagauucaccaucagcagagacaacagcaagaacacccuguaccugcagaugaacagccugagagccgaggacaccgccguguacuacugcaccagaggccugaagauggccaccaucuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31367 - RNA, 651 nt, Artificial Sequence
  derived and/or modified sequence opt4 from Seribantumab_LightChain1
cagagcgcccugacccagcccgccagcgugagcggcagccccggccagagcaucaccaucagcugcaccggcaccagcagcgacgugggcagcuacaacguggugagcugguaccagcagcaccccggcaaggcccccaagcugaucaucuacgaggugagccagagacccagcggcgugagcaacagauucagcggcagcaagagcggcaacaccgccagccugaccaucagcggccugcagaccgaggacgaggccgacuacuacugcugcagcuacgccggcagcagcaucuucgugaucuucggcggcggcaccaaggugaccgugcugggccagcccaaggccgcccccagcgugacccuguucccccccagcagcgaggagcugcaggccaacaaggccacccuggugugccuggugagcgacuucuaccccggcgccgugaccguggccuggaaggccgacggcagccccgugaaggugggcguggagaccaccaagcccagcaagcagagcaacaacaaguacgccgccagcagcuaccugagccugacccccgagcaguggaagagccacagaagcuacagcugcagagugacccacgagggcagcaccguggagaagaccguggcccccgccgagugcagc

SEQ ID NO: 31368 - RNA, 1353 nt, Artificial Sequence
  derived and/or modified sequence opt4 from Setoxaximab_HeavyChain1
gaggugcagcugcagcagcccggccccgagcuggagaagcccggcgccagcgugaagcugagcugcaaggccagcggcuacagcuucaccgacuacaacaugaacugggugaagcagaacaacggcgagagccuggaguggaucggcaagaucgaccccuacuacggcggccccagcuacaaccagaaguucaaggacaaggccacccugaccguggacaagagcagcagcaccgccuacaugcagcugaagagccugaccagcgaggacagcgccguguacuacugcaccagaggcggcaacagagacugguacuucgacguguggggcgccggcaccacccugaccgugagcgccgaguucgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31369 - RNA, 660 nt, Artificial Sequence
  derived and/or modified sequence opt4 from Setoxaximab_LightChain1
gacaucgugcugagccagagccccagcagccugguggugagcgugggcgagaaggugaccaugagcugcaagagcagccagagccugcuguacagcagaaaccagaagaacuaccuggccugguaccagcagaagcccggccagagccccaaggugcugaucuacugggccagcaccagagagagcggcgugcccgacagacugaccggcagcggcagcggcaccgacuucacccugaccaucagcagcgugaaggccgaggaccuggccguguacuacugccagcaguacuacagcuacccccugaccuucggcgccggcaccaagcuggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31370 - RNA, 1338 nt, Artificial Sequence
  derived and/or modified sequence opt4 from Sifalimumab_HeavyChain1
caggugcagcuggugcagagcggcgccgaggugaagaagcccggcgccagcgugaaggugagcugcaaggccagcggcuacaccuucaccagcuacagcaucagcugggugagacaggcccccggccagggccuggaguggaugggcuggaucagcguguacaacggcaacaccaacuacgcccagaaguuccagggcagagugaccaugaccaccgacaccagcaccagcaccgccuaccuggagcugagaagccugagaagcgacgacaccgccguguacuacugcgccagagaccccaucgccgccggcuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31371 - RNA, 645 nt, Artificial Sequence
  derived and/or modified sequence opt4 from Sifalimumab_LightChain1
gagaucgugcugacccagagccccggcacccugagccugagccccggcgagagagccacccugagcugcagagccagccagagcgugagcagcaccuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31372 - RNA, 1347 nt, Artificial Sequence
  derived and/or modified sequence opt4 from Siltuximab_HeavyChain1
gaggugcagcugguggagagcggcggcaagcugcugaagcccggcggcagccugaagcugagcugcgccgccagcggcuucaccuucagcagcuucgccaugagcugguucagacagagccccgagaagagacuggaguggguggccgagaucagcagcggcggcagcuacaccuacuaccccgacaccgugaccggcagauucaccaucagcagagacaacgccaagaacacccuguaccuggagaugagcagccugagaagcgaggacaccgccauguacuacugcgccagaggccuguggggcuacuacgcccuggacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31373 - RNA, 639 nt, Artificial Sequence
  derived and/or modified sequence opt4 from Siltuximab_LightChain1
cagaucgugcugauccagagccccgccaucaugagcgccagccccggcgagaaggugaccaugaccugcagcgccagcagcagcgugagcuacauguacugguaccagcagaagcccggcagcagccccagacugcugaucuacgacaccagcaaccuggccagcggcgugcccgugagauucagcggcagcggcagcggcaccagcuacagccugaccaucagcagaauggaggccgaggacgccgccaccuacuacugccagcaguggagcggcuaccccuacaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31374 - RNA, 1329 nt, Artificial Sequence
  derived and/or modified sequence opt4 from Simtuzumab_HeavyChain1
caggugcagcuggugcagagcggcgccgaggugaagaagcccggcgccagcgugaaggugagcugcaaggccagcggcuacgccuucaccuacuaccugaucgagugggugagacaggcccccggccagggccuggaguggaucggcgugaucaaccccggcagcggcggcaccaacuacaacgagaaguucaagggcagagccaccaucaccgccgacaagagcaccagcaccgccuacauggagcugagcagccugagaagcgaggacaccgccguguacuucugcgccagaaacuggaugaacuucgacuacuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31375 - RNA, 657 nt, Artificial Sequence
  derived and/or modified sequence opt4 from Simtuzumab_LightChain1
gacaucgugaugacccagaccccccugagccugagcgugacccccggccagcccgccagcaucagcugcagaagcagcaagagccugcugcacagcaacggcaacaccuaccuguacugguuccugcagaagcccggccagagcccccaguuccugaucuacagaaugagcaaccuggccagcggcgugcccgacagauucagcggcagcggcagcggcaccgacuucacccugaagaucagcagaguggaggccgaggacgugggcguguacuacugcaugcagcaccuggaguaccccuacaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31376 - RNA, 1347 nt, Artificial Sequence
  derived and/or modified sequence opt4 from Sirukumab_HeavyChain1
gaggugcagcugguggagagcggcggcggccuggugcagcccggcggcagccugagacugagcugcgccgccagcggcuucaccuucagccccuucgccaugagcugggugagacaggcccccggcaagggccuggaguggguggccaagaucagccccggcggcagcuggaccuacuacagcgacaccgugaccggcagauucaccaucagcagagacaacgccaagaacagccuguaccugcagaugaacagccugagagccgaggacaccgccguguacuacugcgccagacagcuguggggcuacuacgcccuggacaucuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31377 - RNA, 639 nt, Artificial Sequence
  derived and/or modified sequence opt4 from Sirukumab_LightChain1
gagaucgugcugacccagagccccgccacccugagccugagccccggcgagagagccacccugagcugcagcgccagcaucagcgugagcuacauguacugguaccagcagaagcccggccaggcccccagacugcugaucuacgacaugagcaaccuggccagcggcauccccgccagauucagcggcagcggcagcggcaccgacuucacccugaccaucagcagccuggagcccgaggacuucgccguguacuacugcaugcaguggagcggcuaccccuacaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31378 - RNA, 1338 nt, Artificial Sequence
  derived and/or modified sequence opt4 from Sofituzumab_vedotin_HeavyChain1
gaggugcagcugguggagagcggcggcggccuggugcagcccggcggcagccugagacugagcugcgccgccagcggcuacagcaucaccaacgacuacgccuggaacugggugagacaggcccccggcaagggccuggagugggugggcuacaucagcuacagcggcuacaccaccuacaaccccagccugaagagcagauucaccaucagcagagacaccagcaagaacacccuguaccugcagaugaacagccugagagccgaggacaccgccguguacuacugcgccagauggaccagcggccuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31379 - RNA, 642 nt, Artificial Sequence
  derived and/or modified sequence opt4 from Sofituzumab_vedotin_LightChain1
gacauccagaugacccagagccccagcagccugagcgccagcgugggcgacagagugaccaucaccugcaaggccagcgaccugauccacaacuggcuggccugguaccagcagaagcccggcaaggcccccaagcugcugaucuacggcgccaccagccuggagaccggcgugcccagcagauucagcggcagcggcagcggcaccgacuucacccugaccaucagcagccugcagcccgaggacuucgccaccuacuacugccagcaguacuggaccacccccuucaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31380 - RNA, 1323 nt, Artificial Sequence
  derived and/or modified sequence opt4 from Solanezumab_HeavyChain1
gaggugcagcugguggagagcggcggcggccuggugcagcccggcggcagccugagacugagcugcgccgccagcggcuucaccuucagcagauacagcaugagcugggugagacaggcccccggcaagggccuggagcugguggcccagaucaacagcgugggcaacagcaccuacuaccccgacaccgugaagggcagauucaccaucagcagagacaacgccaagaacacccuguaccugcagaugaacagccugagagccgaggacaccgccguguacuacugcgccagcggcgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31381 - RNA, 1326 nt, Artificial Sequence
  derived and/or modified sequence opt4 from Solanezumab_HeavyChain
gaggugcagcugguggagagcggcggcggccuggugcagcccggcggcagccugagacugagcugcgccgccagcggcuucaccuucagcagauacagcaugagcugggugagacaggcccccggcaagggccuggagcugguggcccagaucaacagcgugggcaacagcaccuacuaccccgacaccgugaagggcagauucaccaucagcagagacaacgccaagaacacccuguaccugcagaugaacagccugagagccgaggacaccgccguguacuacugcgccagcggcgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31382 - RNA, 657 nt, Artificial Sequence
  derived and/or modified sequence opt4 from Solanezumab_LightChain1
gacguggugaugacccagagcccccugagccugcccgugacccugggccagcccgccagcaucagcugcagaagcagccagagccugaucuacagcgacggcaacgccuaccugcacugguuccugcagaagcccggccagagccccagacugcugaucuacaaggugagcaacagauucagcggcgugcccgacagauucagcggcagcggcagcggcaccgacuucacccugaagaucagcagaguggaggccgaggacgugggcguguacuacugcagccagagcacccacgugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31383 - RNA, 1506 nt, Artificial Sequence
  derived and/or modified sequence opt4 from Solitomab_HeavyChain1
gagcuggugaugacccagagccccagcagccugaccgugaccgccggcgagaaggugaccaugagcugcaagagcagccagagccugcugaacagcggcaaccagaagaacuaccugaccugguaccagcagaagcccggccagccccccaagcugcugaucuacugggccagcaccagagagagcggcgugcccgacagauucaccggcagcggcagcggcaccgacuucacccugaccaucagcagcgugcaggccgaggaccuggccguguacuacugccagaacgacuacagcuacccccugaccuucggcgccggcaccaagcuggagaucaagggcggcggcggcagcggcggcggcggcagcggcggcggcggcagcgaggugcagcugcuggagcagagcggcgccgagcuggugagacccggcaccagcgugaagaucagcugcaaggccagcggcuacgccuucaccaacuacuggcugggcugggugaagcagagacccggccacggccuggaguggaucggcgacaucuuccccggcagcggcaacauccacuacaacgagaaguucaagggcaaggccacccugaccgccgacaagagcagcagcaccgccuacaugcagcugagcagccugaccuucgaggacagcgccguguacuucugcgccagacugagaaacugggacgagcccauggacuacuggggccagggcaccaccgugaccgugagcagcggcggcggcggcagcgacgugcagcuggugcagagcggcgccgaggugaagaagcccggcgccagcgugaaggugagcugcaaggccagcggcuacaccuucaccagauacaccaugcacugggugagacaggcccccggccagggccuggaguggaucggcuacaucaaccccagcagaggcuacaccaacuacgccgacagcgugaagggcagauucaccaucaccaccgacaagagcaccagcaccgccuacauggagcugagcagccugagaagcgaggacaccgccaccuacuacugcgccagauacuacgacgaccacuacugccuggacuacuggggccagggcaccaccgugaccgugagcagcggcgagggcaccagcaccggcagcggcggcagcggcggcagcggcggcgccgacgacaucgugcugacccagagccccgccacccugagccugagccccggcgagagagccacccugagcugcagagccagccagagcgugagcuacaugaacugguaccagcagaagcccggcaaggcccccaagagauggaucuacgacaccagcaagguggccagcggcgugcccgccagauucagcggcagcggcagcggcaccgacuacagccugaccaucaacagccuggaggccgaggacgccgccaccuacuacugccagcaguggagcagcaacccccugaccuucggcggcggcaccaagguggagaucaagcaccaccaccaccaccac

SEQ ID NO: 31384 - RNA, 1506 nt, Artificial Sequence; identical to SEQ ID NO: 31383
  derived and/or modified sequence opt4 from Solitomab_SingleChain

SEQ ID NO: 31385 - RNA, 702 nt, Artificial Sequence
  derived and/or modified sequence opt4 from Sonepcizumab_LightChain_Precursor
augagcgugcccacccaggugcugggccugcugcugcuguggcugaccgacgccagaugcgagaccaccgugacccagagccccagcuuccugagcgccagcgugggcgacagagugaccaucaccugcaucaccaccaccgacaucgacgacgacaugaacugguuccagcaggagcccggcaaggcccccaagcugcugaucagcgagggcaacauccugagacccggcgugcccagcagauucagcagcagcggcuacggcaccgacuucacccugaccaucagcaagcugcagcccgaggacuucgccaccuacuacugccugcagagcgacaaccugcccuucaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31386 - RNA, 1365 nt, Artificial Sequence
  derived and/or modified sequence opt4 from Sonepcizumab_gamma1-Chain_Precursor
auggaguggagcuggguguuccuguucuuccugagcgugaccaccggcgugcacagcgaggugcagcuggugcagagcggcgccgaggugaagaagcccggcgagagccugaagaucagcugccagagcuucggcuacaucuucaucgaccacaccauccacuggaugagacagaugcccggccagggccuggaguggaugggcgccaucagccccagacacgacaucaccaaguacaacgagauguucagaggccaggugaccaucagcgccgacaagagcagcagcaccgccuaccugcaguggagcagccugaaggccagcgacaccgccauguacuucugcgccagaggcggcuucuacggcagcaccaucugguucgacuucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31387 - RNA, 1338 nt, Artificial Sequence
  derived and/or modified sequence opt4 from Stamulumab_HeavyChain1
gugcagcuggugcagagcggcgccgaggugaagaagcccggcgccagcgugaaggugagcugcaaggccagcggcuacaccuucaccagcuacuacaugcacugggugagacaggcccccggccagggccuggaguggaugggcaucaucaaccccagcggcggcagcaccagcuacgcccagaaguuccagggcagagugaccaugaccagagacaccagcaccagcaccguguacauggagcugagcagccugagaagcgaggacaccgccguguacuacugcgccagagacgagaacuggggcuucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31388 - RNA, 633 nt, Artificial Sequence
  derived and/or modified sequence opt4 from Stamulumab_LightChain1
agcuacgagcugacccagccccccagcgugagcgugagccccggccagaccgccagcaucaccugcagcggccacgcccugggcgacaaguucgugagcugguaccagcagaagcccggccagagccccgugcuggugaucuacgacgacacccagagacccagcggcauccccgagagauucagcggcagcaacagcggcaacaccgccacccugaccaucagcggcacccaggccauggacgaggccgacuacuacugccaggccugggacagcagcuucguguucggcggcggcaccaaggugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31389 - RNA, 1356 nt, Artificial Sequence
  derived and/or modified sequence opt4 from Suptavumab_HeavyChain1
gaggugcagcugguggagagcggcggcgaccuggugcagcccggcagaagccugagacugagcugcguggccagcggcuucaccuucgacgacuacgccaugcacugggugagacaggcccccggcaagggccuggagugggugagcggcgugagcuggagcggcagcaccgugggcuacgccgacagcgugaagggcagauucaccgugagcagagacaacgcccagaagagccuguaccugcagaugaacagccugagagccgaggacaccgcccuguacuacugcgugaaggacgccuacaaguucaacuacuacuacuacggccuggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31390 - RNA, 642 nt, Artificial Sequence
  derived and/or modified sequence opt4 from Suptavumab_LightChain1
gagaucgugaugacccagagccccgccacccugagcgugagccccggcgagagagccacccugagcugcagagccagccagaccauccugagcaaccuggccugguaccugcagaagcccggccaggcccccagacugcugaucuacggcgccagcaccagagccaccggccugcccgccagauucagcggcagcggcagcggcaccgaguucacccugaccaucagcagccugcagagcgaggacuucgccguguacuacugccagcaguacaacaacuggccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31391 - RNA, 1344 nt, Artificial Sequence
  derived and/or modified sequence opt4 from Suvizumab_HeavyChain1
caggugcagcuggugcagagcggcgccgaggugaagaagcccggcgccagcgugaaggugagcugcaaggccagcggcuacaccuucaccaacagcuggaucggcugguucagacaggcccccggccagggccuggaguggaucggcgacaucuaccccggcggcggcuacaccaacuacaacgagaucuucaagggcaaggccaccaugaccgccgacaccagcaccaacaccgccuacauggagcugagcagccugagaagcgaggacaccgccguguacuacugcagcagaggcauccccggcuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31392 - RNA, 660 nt, Artificial Sequence
  derived and/or modified sequence opt4 from Suvizumab_LightChain1
gacauccagaugacccagagacccgacagccugagcgccagcgugggcgacagagugaccaugagcugcaagagcagccagagccugcugaacagcggcgaccagaagaacuaccugaccugguaccagcagaagcccggccagccccccaagcugcugaucuacugggccagcaccggcgagagcggcgugcccgacagauucagcggcagcggcagcggcaccgacuucaccuucaccaucagcagccugcagcccgaggacaucgccaccuacuacugccagaacgacuacagcuaccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31393 - RNA, 1350 nt, Artificial Sequence
  derived and/or modified sequence opt4 from Tabalumab_HeavyChain1
caggugcagcugcagcaguggggcgccggccugcugaagcccagcgagacccugagccugaccugcgccguguacggcggcagcuucagcggcuacuacuggagcuggaucagacagccccccggcaagggccuggaguggaucggcgagaucaaccacagcggcagcaccaacuacaaccccagccugaagagcagagugaccaucagcguggacaccagcaagaaccaguucagccugaagcugagcagcgugaccgccgccgacaccgccguguacuacugcgccagaggcuacuacgacauccugaccggcuacuacuacuacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31394 - RNA, 642 nt, Artificial Sequence
  derived and/or modified sequence opt4 from Tabalumab_LightChain1
gagaucgugcugacccagagccccgccacccugagccugagccccggcgagagagccacccugagcugcagagccagccagagcgugagcagauaccuggccugguaccagcagaagcccggccaggcccccagacugcugaucuacgacgccagcaacagagccaccggcauccccgccagauucagcggcagcggcagcggcaccgacagcacccugaccaucagcagccuggagcccgaggacuucgccguguacuacugccagcagagaagcaacuggcccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcaacacccugacccugagcaaggccgacuacgagaagcacaagguguacgccugcgaggugacccaccagggccugagcagccccgugaccaagagcuucaacagaggcgagugc

SEQ ID NO: 31395 - RNA, 1332 nt, Artificial Sequence
  derived and/or modified sequence opt4 from Tacatuzuab_HeavyChain1
caggugcagcugcagcagagcggcgccgaggugaagaagcccggcagcagcgugaaggugagcugcaaggccagcggcuacgccuucaccagcuacgugauccacugggugagacaggcccccggccagggccuguacuggaucggcuacauccaccccuacaacggcggcaccaaguacaacgagaaguucaagggcaaggccaccaucaccgccgacgagagcaccaacaccgccuacgagcugagcagccugagaagcgaggacaccgccuucuacuucugcgccagaagcggcggcggcgaccccuucgccuacuggggccagggcagccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggcaag

SEQ ID NO: 31396 - RNA, 636 nt, Artificial Sequence
  derived and/or modified sequence opt4 from Tacatuzuab_LightChain1
gacauccagcugacccagagccccagcagccugagcgccagcgugggcgacagagugaccaucaccugcaaggccagccaggacaucaacaaguacaucggcugguaccagcagaagcccggcaaggcccccaagcugcugcacuacaccagcgcccugcugcccggcauccccagcagauucagcggcagcggcagcggcagagacuacaccuucaccaucagcagccugcagcccgaggacaucgccaccuacuacugccugcaguacgacgaccuguggaccuucggcggcggcaccaagcugcagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31397 - RNA, 678 nt, Artificial Sequence
  derived and/or modified sequence opt4 from Tadocizumab_fab_fragment_HeavyChain
caggugcagcuggugcagagcggcgccgaggugaagaagcccggcagcagcgugaaggugagcugcaaggccagcggcuacgccuucaccaacuaccugaucgagugggugagacaggcccccggccagggccuggaguggaucggcgugaucuaccccggcagcggcggcaccaacuacaacgagaaguucaagggcagagugacccugaccguggacgagagcaccaacaccgccuacauggagcugagcagccugagaagcgaggacaccgccguguacuucugcgccagaagagacggcaacuacggcugguucgccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccac

SEQ ID NO: 31398 - RNA, 582 nt, Artificial Sequence
  derived and/or modified sequence opt4 from Tadocizumab_fab_fragment_LightChain
gacauccagaugacccagacccccagcacccugagcgccagcgugggcgacagagugaccaucagcugcagagccagccaggacaucaacaacuaccugaacugguaccagcagaagcccggcaaggcccccaagcugcugaucuacuacaccagcacccugcacagcggcgugcccagcagauucagcggcagcggcagcggcaccgacuacacccugaccaucagcagccugcagcccgacgacuucgccaccuacuucugccagcagggcaacacccugcccuggaccuucggccagggcaccaagguggaggugaagagaaccguggccgcccccagcguguucaucuucccccccagcgacgagcagcugaagagcggcaccgccagcguggugugccugcugaacaacuucuacgagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31399 - RNA, 1359 nt, Artificial Sequence
  derived and/or modified sequence opt4 from Talizumab_HeavyChain1
caggugcagcuggugcagagcggcgccgaggugaagaagcccggcgccagcgugaaggugagcugcaaggccagcggcuacaccuucagcauguacuggcuggagugggugagacaggcccccggccacggccuggagugggugggcgagaucagccccggcaccuucaccaccaacuacaacgagaaguucaaggccagagccaccuucaccgccgacaccagcaccaacaccgccuacauggagcugagcagccugagaagcgaggacaccgccguguacuacugcgccagauucagccacuucagcggcagcaacuacgacuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31400 - RNA, 642 nt, Artificial Sequence
  derived and/or modified sequence opt4 from Talizumab_LightChain1
gacauccugcugacccagagccccggcacccugagccugagccccggcgagagagccacccugagcugcagagccagccagagcaucggcaccaacauccacugguaccagcagaagcccggccaggcccccagacugcugaucaaguacgccagcgagagcaucagcggcauccccagcagauucagcggcagcggcagcggcaccgacuucacccugaccaucagcagacuggagcccgaggacuucgccauguacuacugccagcagagcgacagcuggcccaccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31401 - RNA, 1368 nt, Artificial Sequence
  derived and/or modified sequence opt4 from Tamtuvetmab_HeavyChain1
gaggugaagcugcuggagagcggcggcggccuggugcagcccggcggcagcaugagacugagcugcgccggcagcggcuucaccuucaccgacuucuacaugaacuggaucagacagcccgccggcaaggcccccgaguggcugggcuucaucagagacaaggccaagggcuacaccaccgaguacaaccccagcgugaagggcagauucaccaucagcagagacaacacccagaacaugcuguaccugcagaugaacacccugagagccgaggacaccgccaccuacuacugcgccagagagggccacaccgccgcccccuucgacuacuggggccagggcacccuggugaccgugagcagcgccagcaccaccgcccccagcguguucccccuggcccccagcugcggcagcaccagcggcagcaccguggcccuggccugccuggugagcggcuacuuccccgagcccgugaccgugagcuggaacagcggcagccugaccagcggcgugcacaccuuccccagcgugcugcagagcagcggccuguacagccugagcagcauggugaccgugcccagcagcagauggcccagcgagaccuucaccugcaacguggcccaccccgccagcaagaccaagguggacaagcccgugcccaagagagagaacggcagagugcccagaccccccgacugccccaagugccccgcccccgagaugcugggcggccccagcguguucaucuucccccccaagcccaaggacacccugcugaucgccagaacccccgaggugaccugcguggugguggaccuggaccccgaggaccccgaggugcagaucagcugguucguggacggcaagcagaugcagaccgccaagacccagcccagagaggagcaguucaacggcaccuacagaguggugagcgugcugcccaucggccaccaggacuggcugaagggcaagcaguucaccugcaaggugaacaacaaggcccugcccagccccaucgagagaaccaucagcaaggccagaggccaggcccaccagcccagcguguacgugcugccccccagcagagaggagcugagcaagaacaccgugagccugaccugccugaucaaggacuucuucccccccgacaucgacguggaguggcagagcaacggccagcaggagcccgagagcaaguacagaaccacccccccccagcuggacgaggacggcagcuacuuccuguacagcaagcugagcguggacaagagcagauggcagagaggcgacaccuucaucugcgccgugaugcacgaggcccugcacaaccacuacacccagaagagccugagccacagccccggcaag

SEQ ID NO: 31402 - RNA, 639 nt, Artificial Sequence
  derived and/or modified sequence opt4 from Tamtuvetmab_LightChain1
gacaucaagaugacccagagccccagcuuccugagcgccagcgugggcgacagagugacccugaacugcaaggccagccagaacaucgacaaguaccugaacugguaccagcagaagcugggcgagagccccaagcugcugaucuacaacaccaacaaccugcagaccggcauccccagcagauucagcggcagcggcagcggcaccgacuucacccugaccaucagcagccugcagcccgaggacguggccaccuacuucugccugcagcacaucagcagacccagaaccuucggcggcggcacccaccugaccgugcugggccagcccaaggccagccccagcgugacccuguucccccccagcagcgaggagcugggcgccaacaaggccacccuggugugccugaucagcgacuucuaccccagcggcgugaccguggccuggaaggccgacggcagccccaucacccagggcguggagaccaccaagcccagcaagcagagcaacaacaaguacgccgccagcagcuaccugagccugacccccgacaaguggaagagccacagcagcuucagcugccuggugacccacgagggcagcaccguggagaagaagguggcccccgccgagugcagc

SEQ ID NO: 31403 - RNA, 360 nt, Artificial Sequence
  derived and/or modified sequence opt4 from Tanezumab_HeavyChain
caggugcagcugcaggagagcggccccggccuggugaagcccagcgagacccugagccugaccugcaccgugagcggcuucagccugaucggcuacgaccugaacuggaucagacagccccccggcaagggccuggaguggaucggcaucaucuggggcgacggcaccaccgacuacaacagcgccgugaagagcagagugaccaucagcaaggacaccagcaagaaccaguucagccugaagcugagcagcgugaccgccgccgacaccgccguguacuacugcgccagaggcggcuacugguacgccaccagcuacuacuucgacuacuggggccagggcacccuggugaccgugagc

SEQ ID NO: 31404 - RNA, 327 nt, Artificial Sequence
  derived and/or modified sequence opt4 from Tanezumab_LightChain
gacauccagaugacccagagccccagcagccugagcgccagcgugggcgacagagugaccaucaccugcagagccagccagagcaucagcaacaaccugaacugguaccagcagaagcccggcaaggcccccaagcugcugaucuacuacaccagcagauuccacagcggcgugcccagcagauucagcggcagcggcagcggcaccgacuucaccuucaccaucagcagccugcagcccgaggacaucgccaccuacuacugccagcaggagcacacccugcccuacaccuucggccagggcaccaagcuggagaucaagagaacc

SEQ ID NO: 31405 - RNA, 1323 nt, Artificial Sequence
  derived and/or modified sequence opt4 from Tarextumab_HeavyChain1
gaggugcagcugguggagagcggcggcggccuggugcagcccggcggcagccugagacugagcugcgccgccagcggcuucaccuucagcagcagcggcaugagcugggugagacaggcccccggcaagggccuggagugggugagcgugaucgccagcagcggcagcaacaccuacuacgccgacagcgugaagggcagauucaccaucagcagagacaacagcaagaacacccuguaccugcagaugaacagccugagagccgaggacaccgccguguacuacugcgccagaagcaucuucuacaccaccuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31406 - RNA, 645 nt, Artificial Sequence
  derived and/or modified sequence opt4 from Tarextumab_LightChain1
gacaucgugcugacccagagccccgccacccugagccugagccccggcgagagagccacccugagcugcagagccagccagagcgugagaagcaacuaccuggccugguaccagcagaagcccggccaggcccccagacugcugaucuacggcgccagcagcagagccaccggcgugcccgccagauucagcggcagcggcagcggcaccgacuucacccugaccaucagcagccuggagcccgaggacuucgccguguacuacugccagcaguacagcaacuuccccaucaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31407 - RNA, 363 nt, Artificial Sequence
  derived and/or modified sequence opt4 from Tefibazumab_HeavyChain1
caggugcagcugaaggagagcggccccggccuggugaagcccagccagacccugagcaucaccugcaccaucagcggcuucagccugagcagauacagcgugcacugggugagacagccccccggcaagggccuggaguggcugggcaugaucuggggcggcggcaacaccgacuacaacagcgcccugaagagcagacugagcaucagcaaggacaacagcaagaaccagguguuccugaagaugaacagccugaccgccgccgacaccgccguguacuacugcgccagaaagggcgaguucuacuacggcuacgacggcuucguguacuggggccagggcacccuggugaccgugagcagc

SEQ ID NO: 31408 - RNA, 336 nt, Artificial Sequence
  derived and/or modified sequence opt4 from Tefibazumab_LightChain1
gacaucgugaugacccagagccccgacagccuggccgugagccugggcgagagagugaccaugaacugcaagagcagccagagcgugcuguacagcagcaaccagaagaacuaccuggccugguaccagcagaagcccggccagagccccaagcugcugaucuacugggccagcaccagagagagcggcgugcccgacagauucagcggcagcggcagcggcaccgacuucacccugaccaucagcagcgugcaggccgaggaccuggccguguacuacugccaccaguaccugagcagcuacaccuucggcggcggcaccaagcuggagaucaag

SEQ ID NO: 31409 - RNA, 1368 nt, Artificial Sequence
  derived and/or modified sequence opt4 from Tenatumomab_HeavyChain1
gagauccagcugcagcagagcggccccgagcuggugaagcccggcgccagcgugaaggugagcugcaaggccagcggcuacgccuucaccagcuacaacauguacugggugaagcagagccacggcaagagccuggaguggaucggcuacaucgaccccuacaacggcgugaccagcuacaaccagaaguucaagggcaaggccacccugaccguggacaagagcagcagcaccgccuacaugcaccugaacagccugaccagcgaggacagcgccguguacuacugcgccagaggcggcggcagcaucuacuacgccauggacuacuggggccagggcaccagcgugaccgugagcagcgccaagaccaccccccccagcguguacccccuggcccccggcugcggcgacaccaccggcagcagcgugacccugggcugccuggugaagggcuacuuccccgagagcgugaccgugaccuggaacagcggcagccugagcagcagcgugcacaccuuccccgcccugcugcagagcggccuguacaccaugagcagcagcgugaccgugcccagcagcaccuggcccagccagaccgugaccugcagcguggcccaccccgccagcagcaccaccguggacaagaagcuggagcccagcggccccaucagcaccaucaaccccugcccccccugcaaggagugccacaagugccccgcccccaaccuggagggcggccccagcguguucaucuucccccccaacaucaaggacgugcugaugaucagccugacccccaaggugaccugcguggugguggacgugagcgaggacgaccccgacgugcagaucagcugguucgugaacaacguggaggugcacaccgcccagacccagacccacagagaggacuacaacagcaccaucagaguggugagcacccugcccauccagcaccaggacuggaugagcggcaaggaguucaagugcaaggugaacaacaaggaccugcccagccccaucgagagaaccaucagcaagaucaagggccuggugagagccccccagguguacauccugcccccccccgccgagcagcugagcagaaaggacgugagccugaccugccugguggugggcuucaaccccggcgacaucagcguggaguggaccagcaacggccacaccgaggagaacuacaaggacaccgcccccgugcuggacagcgacggcagcuacuucaucuacagcaagcugaacaugaagaccagcaagugggagaagaccgacagcuucagcugcaacgugagacacgagggccugaagaacuacuaccugaagaagaccaucagcagaagccccggcaag

SEQ ID NO: 31410 - RNA, 657 nt, Artificial Sequence
  derived and/or modified sequence opt4 from Tenatumomab_LightChain1
gacaucgugaugacccaggccgcccccagcgugcccgugacccccggcgagagcgugagcaucagcugcagaagcagcaagagccugcugcacagcaacggcaacaccuaccuguacugguuccugcagagacccggccagagcccccagcugcugaucuacagaaugagcaaccuggccagcggcgugcccgacagauucagcggcagcggcagcggcaccgccuucacccugagaaucagcagaguggaggccgaggacgugggcguguacuacugcaugcagcaccuggaguacccccugaccuucggcgccggcaccaagcuggagcugaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 31411 - RNA, 1356 nt, Artificial Sequence
  derived and/or modified sequence opt4 from Teneliximab_HeavyChain1
cagauccagcuggugcagagcggccccgagcugaagaagcccggcgagaccgugagaaucagcugcaaggccagcggcuacgccuucaccaccaccggcaugcagugggugcaggagaugcccggcaagggccugaaguggaucggcuggaucaacacccacagcggcgugcccaaguacguggaggacuucaagggcagauucgccuucagccuggagaccagcgccaacaccgccuaccugcagaucagcaaccugaagaacgaggacaccgccaccuacuucugcgugagaagcggcaacggcaacuacgaccuggccuacuucgccuacuggggccagggcacccuggugaccgugagcgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31412 - RNA, 642 nt, Artificial Sequence
  derived and/or modified sequence opt4 from Teneliximab_LightChain1
gacaucgugcugacccagagccccgccacccugagcgugacccccggcgacagagugagccugagcugcagagccagccagagcaucagcgacuaccugcacugguaccagcagaagagccacgagagccccagacugcugaucaaguacgccagccacagcaucagcggcauccccagcagauucagcggcagcggcagcggcagcgacuucacccugagcaucaacagcguggagcccgaggacgugggcaucuacuacugccagcacggccacagcuuccccuggaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31413 - RNA, 1347 nt, Artificial Sequence
  derived and/or modified sequence opt4 from Teplizumab_HeavyChain1
caggugcagcuggugcagagcggcggcggcguggugcagcccggcagaagccugagacugagcugcaaggccagcggcuacaccuucaccagauacaccaugcacugggugagacaggcccccggcaagggccuggaguggaucggcuacaucaaccccagcagaggcuacaccaacuacaaccagaaggugaaggacagauucaccaucagcagagacaacagcaagaacaccgccuuccugcagauggacagccugagacccgaggacaccggcguguacuucugcgccagauacuacgacgaccacuacugccuggacuacuggggccagggcacccccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31414 - RNA, 639 nt, Artificial Sequence
  derived and/or modified sequence opt4 from Teplizumab_LightChain1
gacauccagaugacccagagccccagcagccugagcgccagcgugggcgacagagugaccaucaccugcagcgccagcagcagcgugagcuacaugaacugguaccagcagacccccggcaaggcccccaagagauggaucuacgacaccagcaagcuggccagcggcgugcccagcagauucagcggcagcggcagcggcaccgacuacaccuucaccaucagcagccugcagcccgaggacaucgccaccuacuacugccagcaguggagcagcaaccccuucaccuucggccagggcaccaagcugcagaucaccagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31415 - RNA, 1344 nt, Artificial Sequence
  derived and/or modified sequence opt4 from Teprotumumab_HeavyChain1
cagguggagcugguggagagcggcggcggcguggugcagcccggcagaagccagagacugagcugcgccgccagcggcuucaccuucagcagcuacggcaugcacugggugagacaggcccccggcaagggccuggaguggguggccaucaucugguucgacggcagcagcaccuacuacgccgacagcgugagaggcagauucaccaucagcagagacaacagcaagaacacccuguaccugcagaugaacagccugagagccgaggacaccgccguguacuucugcgccagagagcugggcagaagauacuucgaccuguggggcagaggcacccuggugagcgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31416 - RNA, 645 nt, Artificial Sequence
  derived and/or modified sequence opt4 from Teprotumumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaagagagccaccggcauccccgccagauucagcggcagcggcagcggcaccgacuucacccugaccaucagcagccuggagcccgaggacuucgccguguacuacugccagcagagaagcaaguggccccccuggaccuucggccagggcaccaagguggagagcaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31417 - RNA, 1338 nt, Artificial Sequence
  derived and/or modified sequence opt4 from Tesidolumab_HeavyChain1
gaggugcagcuggugcagagcggcgccgaggugaagaagcccggcagcagcgugaaggugagcugcaaggccagcggcggcaccuucagcagcuacgccaucagcugggugagacaggcccccggccagggccuggaguggaugggcggcaucggccccuucuucggcaccgccaacuacgcccagaaguuccagggcagagugaccaucaccgccgacgagagcaccagcaccgccuacauggagcugagcagccugagaagcgaggacaccgccguguacuacugcgccagagacacccccuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31418 - RNA, 642 nt, Artificial Sequence
  derived and/or modified sequence opt4 from Tesidolumab_LightChain1
agcuacgagcugacccagccccugagcgugagcguggcccugggccagaccgccagaaucaccugcagcggcgacagcauccccaacuacuacguguacugguaccagcagaagcccggccaggcccccgugcuggugaucuacgacgacagcaacagacccagcggcauccccgagagauucagcggcagcaacagcggcaacaccgccacccugaccaucagcagagcccaggccggcgacgaggccgacuacuacugccagagcuucgacagcagccugaacgccgagguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31419 - RNA, 1344 nt, Artificial Sequence
  derived and/or modified sequence opt4 from Tezepelumab_HeavyChain1
cagaugcagcugguggagagcggcggcggcguggugcagcccggcagaagccugagacugagcugcgccgccagcggcuucaccuucagaaccuacggcaugcacugggugagacaggcccccggcaagggccuggaguggguggccgugaucugguacgacggcagcaacaagcacuacgccgacagcgugaagggcagauucaccaucaccagagacaacagcaagaacacccugaaccugcagaugaacagccugagagccgaggacaccgccguguacuacugcgccagagccccccagugggagcuggugcacgaggccuucgacaucuggggccagggcaccauggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31420 - RNA, 642 nt, Artificial Sequence
  derived and/or modified sequence opt4 from Tezepelumab_LightChain1
agcuacgugcugacccagccccccagcgugagcguggcccccggccagaccgccagaaucaccugcggcggcaacaaccugggcagcaagagcgugcacugguaccagcagaagcccggccaggcccccgugcuggugguguacgacgacagcgacagacccagcuggauccccgagagauucagcggcagcaacagcggcaacaccgccacccugaccaucagcagaggcgaggccggcgacgaggccgacuacuacugccaggugugggacagcagcagcgaccacgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31421 - RNA, 1338 nt, Artificial Sequence
  derived and/or modified sequence opt4 from ThioMAb-chMA79b-HC(A118C)_HeavyChain
gaggugcagcugcagcagagcggcgccgagcugaugaagcccggcgccagcgugaagaucagcugcaaggccaccggcuacaccuucagcagcuacuggaucgagugggugaagcagagacccggccacggccuggaguggaucggcgagauccugcccggcggcggcgacaccaacuacaacgagaucuucaagggcaaggccaccuucaccgccgacaccagcagcaacaccgccuacaugcagcugagcagccugaccagcgaggacagcgccguguacuacugcaccagaagagugcccguguacuucgacuacuggggccagggcaccagcgugaccgugagcagcugcagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31422 - RNA, 1347 nt, Artificial Sequence
  derived and/or modified sequence opt4 from ThioMab-hu10A8.v1-HC(A118C)_HeavyChain
gaggugcagcugguggagagcggcggcggccuggugcagcccggcggcagccugagacugagcugcgccgccagcggcuucaccuucagcagcuacgccgugagcugggugagacaggcccccggcaagggccuggaguggguggccaccaucagcagcggcggcagccugaccuucuaccuggacagcgugagaggcagauucaccaucagcagagacaacagcaagaacacccuguaccugcagaugaacagccugagagccgaggacaccgccguguacuacugcgccagacccauccccgacuacuacgcccuggacuacuggggccagggcacccuggugaccgugagcagcugcagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31423 - RNA, 1347 nt, Artificial Sequence
  derived and/or modified sequence opt4 from ThioMab-hu10A8.v1-HC(V205C)_HeavyChain
gaggugcagcugguggagagcggcggcggccuggugcagcccggcggcagccugagacugagcugcgccgccagcggcuucaccuucagcagcuacgccgugagcugggugagacaggcccccggcaagggccuggaguggguggccaccaucagcagcggcggcagccugaccuucuaccuggacagcgugagaggcagauucaccaucagcagagacaacagcaagaacacccuguaccugcagaugaacagccugagagccgaggacaccgccguguacuacugcgccagacccauccccgacuacuacgcccuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31424 - RNA, 642 nt, Artificial Sequence
  derived and/or modified sequence opt4 from ThioMab-hu10A8.v1-LC(A118C)_LightChain
gacauccagaugacccagagccccagcagccugagcgccagcgugggcgacagagugaccaucaccugcaaggccagccaggacgugagcaccgccguggccugguaccagcagaagcccggcaaggcccccaagcugcugaucuacagcgccagcuacagauacaccggcgugcccagcagauucagcggcagcggcagcggcaccgacuucacccugaccaucagcagccugcagcccgaggacuucgccaccuacuacugccagcagcacuucagcagccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31425 - RNA, 642 nt, Artificial Sequence
  derived and/or modified sequence opt4 from ThioMab-hu10A8.v1-LC(V205C)_LightChain
gacauccagaugacccagagccccagcagccugagcgccagcgugggcgacagagugaccaucaccugcaaggccagccaggacgugagcaccgccguggccugguaccagcagaagcccggcaaggcccccaagcugcugaucuacagcgccagcuacagauacaccggcgugcccagcagauucagcggcagcggcagcggcaccgacuucacccugaccaucagcagccugcagcccgaggacuucgccaccuacuacugccagcagcacuucagcagccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccugcaccaagagcuucaacagaggcgagugc

SEQ ID NO: 31426 - RNA, 1338 nt, Artificial Sequence
  derived and/or modified sequence opt4 from ThioMAb-huMA79b.v17-HC(A118C)_HeavyChain
gaggugcagcugguggagagcggcggcggccuggugcagcccggcggcagccugagacugagcugcgccgccagcggcuacaccuucagcagcuacuggaucgagugggugagacaggcccccggcaagggccuggaguggaucggcgagauccugcccggcggcggcgacaccaacuacaacgagaucuucaagggcagagccaccuucagcgccgacaccagcaagaacaccgccuaccugcagaugaacagccugagagccgaggacaccgccguguacuacugcaccagaagagugcccguguacuucgacuacuggggccagggcacccuggugaccgugagcagcugcagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31427 - RNA, 654 nt, Artificial Sequence
  derived and/or modified sequence opt4 from ThioMAb-huMA79b.v17-HC(A118C)_LightChain
gacauccagcugacccagagccccagcagccugagcgccagcgugggcgacagagugaccaucaccugcaaggccagccagagcguggacuacgacggcgacagcuuccugaacugguaccagcagaagcccggcaaggcccccaagcugcugaucuacgccgccagcaaccuggagagcggcgugcccagcagauucagcggcagcggcagcggcaccgacuucacccugaccaucagcagccugcagcccgaggacuucgccaccuacuacugccagcagagcaacgaggacccccugaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31428 - RNA, 1338 nt, Artificial Sequence
  derived and/or modified sequence opt4 from ThioMAb-huMA79b.v18-HC(A118C)_HeavyChain
gaggugcagcugguggagagcggcggcggccuggugcagcccggcggcagccugagacugagcugcgccgccagcggcuacaccuucagcagcuacuggaucgagugggugagacaggcccccggcaagggccuggaguggaucggcgagauccugcccggcggcggcgacaccaacuacaacgagaucuucaagggcagagccaccuucagcgccgacaccagcaagaacaccgccuaccugcagaugaacagccugagagccgaggacaccgccguguacuacugcaccagaagagugcccaucagacuggacuacuggggccagggcacccuggugaccgugagcagcugcagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31429 - RNA, 654 nt, Artificial Sequence; identical to SEQ ID NO: 31273
  derived and/or modified sequence opt4 from ThioMAb-huMA79b.v28-HC(A118C)_LightChain

SEQ ID NO: 31430 - RNA, 654 nt, Artificial Sequence
  derived and/or modified sequence opt4 from ThioMAb-huMA79b.v28-LC(V205C)_LightChain
gacaucgugcugacccagagccccgccagccuggccgugagccugggccagagagccaccaucagcugcaaggccagccagagcguggacuacgacggcgacagcuuccugaacugguaccagcagaagcccggccagccccccaagcuguucaucuacgccgccagcaaccuggagagcggcauccccgccagauucagcggcagcggcagcggcaccgacuucacccugaacauccaccccguggaggaggaggacgccgccaccuacuacugccagcagagcaacgaggacccccugaccuucggcgccggcaccgagcuggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccugcaccaagagcuucaacagaggcgagugc

SEQ ID NO: 31431 - RNA, 1332 nt, Artificial Sequence
  derived and/or modified sequence opt4 from Ticiliuab_HeavyChain1
caggugcagcugguggagagcggcggcggcguggugcagcccggcagaagccugagacugagcugcgccgccagcggcuucaccuucagcagcuacggccacugggugagacaggcccccggcaagggccuggaguggguggccgugaucugguacgacggcagcaacaaguacuacgccgacagcgugaagggcagauucaccaucagcagagacaacagcaagaacacccuguaccugcagaacagccugagagccgaggacaccgccguguacuacugcgccagagaccccagaggcgccacccuguacuacuacuacuacggcgacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccacccccccccuggacagcgacggcagcuucuuccuguacagcaagcugaccguggacaagagcagauggcagcagggcaacguguucagcugcagcgugcacgaggcccugcacaaccacuacacccagaagagccugagccugagccccggcaag

SEQ ID NO: 31432 - RNA, 639 nt, Artificial Sequence
  derived and/or modified sequence opt4 from Ticiliuab_LightChain1
gacauccagacccagagccccagcagccugagcgccagcgugggcgacagagugaccaucaccugcagagccagccagagcaucaacagcuaccuggacugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcaguacuacagcacccccuucaccuucggccccggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31433 - RNA, 1347 nt, Artificial Sequence
  derived and/or modified sequence opt4 from Tigatuzumab_HeavyChain1
gaggugcagcugguggagagcggcggcggccuggugcagcccggcggcagccugagacugagcugcgccgccagcggcuucaccuucagcagcuacgugaugagcugggugagacaggcccccggcaagggccuggaguggguggccaccaucagcagcggcggcagcuacaccuacuaccccgacagcgugaagggcagauucaccaucagcagagacaacgccaagaacacccuguaccugcagaugaacagccugagagccgaggacaccgccguguacuacugcgccagaagaggcgacagcaugaucaccaccgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31434 - RNA, 1347 nt, Artificial Sequence; identical to SEQ ID NO: 31433
  derived and/or modified sequence opt4 from Tigatuzumab_HeavyChain

SEQ ID NO: 31435 - RNA, 639 nt, Artificial Sequence
  derived and/or modified sequence opt4 from Tigatuzumab_LightChain1
gacauccagaugacccagagccccagcagccugagcgccagcgugggcgacagagugaccaucaccugcaaggccagccaggacgugggcaccgccguggccugguaccagcagaagcccggcaaggcccccaagcugcugaucuacugggccagcaccagacacaccggcgugcccagcagauucagcggcagcggcagcggcaccgacuucacccugaccaucagcagccugcagcccgaggacuucgccaccuacuacugccagcaguacagcagcuacagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31436 - RNA, 639 nt, Artificial Sequence; identical to SEQ ID NO: 31435
  derived and/or modified sequence opt4 from Tigatuzumab_LightChain

SEQ ID NO: 31437 - RNA, 1338 nt, Artificial Sequence
  derived and/or modified sequence opt4 from Tildrakizumab_HeavyChain1
caggugcagcuggugcagagcggcgccgaggugaagaagcccggcgccagcgugaaggugagcugcaaggccagcggcuacaucuucaucaccuacuggaugaccugggugagacaggcccccggccagggccuggaguggaugggccagaucuuccccgccagcggcagcgccgacuacaacgagaaguucgagggcagagugaccaugaccaccgacaccagcaccagcaccgccuacauggagcugagaagccugagaagcgacgacaccgccguguacuacugcgccagaggcggcggcggcuucgccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31438 - RNA, 642 nt, Artificial Sequence
  derived and/or modified sequence opt4 from Tildrakizumab_LightChain1
gacauccagaugacccagagccccagcagccugagcgccagcgugggcgacagagugaccaucaccugcagaaccagcgagaacaucuacagcuaccuggccugguaccagcagaagcccggcaaggcccccaagcugcugaucuacaacgccaagacccuggccgagggcgugcccagcagauucagcggcagcggcagcggcaccgacuucacccugaccaucagcagccugcagcccgaggacuucgccaccuacuacugccagcaccacuacggcauccccuucaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31439 - RNA, 1344 nt, Artificial Sequence
  derived and/or modified sequence opt4 from Tisotumab_vedotin_HeavyChain1
gaggugcagcugcuggagagcggcggcggccuggugcagcccggcggcagccugagacugagcugcgccgccagcggcuucaccuucagcaacuacgccaugagcugggugagacaggcccccggcaagggccuggagugggugagcagcaucagcggcagcggcgacuacaccuacuacaccgacagcgugaagggcagauucaccaucagcagagacaacagcaagaacacccuguaccugcagaugaacagccugagagccgaggacaccgccguguacuacugcgccagaagccccuggggcuacuaccuggacagcuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31440 - RNA, 642 nt, Artificial Sequence
  derived and/or modified sequence opt4 from Tisotumab_vedotin_LightChain1
gacauccagaugacccagagcccccccagccugagcgccagcgccggcgacagagugaccaucaccugcagagccagccagggcaucagcagcagacuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuaccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31441 - RNA, 1341 nt, Artificial Sequence
  derived and/or modified sequence opt4 from Tocilizumab_HeavyChain1
gugcagcugcaggagagcggccccggccuggugagacccagccagacccugagccugaccugcaccgugagcggcuacagcaucaccagcgaccacgccuggagcugggugagacagccccccggcagaggccuggaguggaucggcuacaucagcuacagcggcaucaccaccuacaaccccagccugaagagcagagugaccaugcugagagacaccagcaagaaccaguucagccugagacugagcagcgugaccgccgccgacaccgccguguacuacugcgccagaagccuggccagaaccaccgccauggacuacuggggccagggcagccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31442 - RNA, 642 nt, Artificial Sequence
  derived and/or modified sequence opt4 from Tocilizumab_LightChain1
gacauccagaugacccagagccccagcagccugagcgccagcgugggcgacagagugaccaucaccugcagagccagccaggacaucagcagcuaccugaacugguaccagcagaagcccggcaaggcccccaagcugcugaucuacuacaccagcagacugcacagcggcgugcccagcagauucagcggcagcggcagcggcaccgacuucaccuucaccaucagcagccugcagcccgaggacaucgccaccuacuacugccagcagggcaacacccugcccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31443 - RNA, 1353 nt, Artificial Sequence
  derived and/or modified sequence opt4 from Tosatoxumab_HeavyChain1
gaggugcagauggugcagagcggcgccgaggugaagaagcccggcgagccccugaagaucagcugcaagggcagcggcuacaaguucggcacccacuggaucggcugggugagacagagacccggcaagggccuggaguggaugggcaucauccaccccgccgacagcgagaccaaguacagccccagcuuccagggccaggugagcuucagcgccgacaagagcagcaacaccgccuaccugcacuggagcacccugagagccagcgacaccgccauguacuacugcgccagaagaagcggcagcagcagcugguacgcccuggacuucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31444 - RNA, 651 nt, Artificial Sequence
  derived and/or modified sequence opt4 from Tosatoxumab_LightChain1
cagagcgugcugacccagagccccagcgccagcggcacccccggccagagagugaccaucagcugcagcggcggcagcagcaacaucggcagcaacaccgugaacugguaccagcaguuccccggcgccgcccccaagcugcugaucuacaccaacaaccagagacccagcggcgugcccgacagauucagcggcagcaagagcggcaccagcgccagccuggccaucagcggccugcagagcgaggacgaggccgacuacuacugcgccaccugggacgacagccugaacggccuguacguguucggcaccggcaccaaggugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacggcagccccgugaaggccggcguggagaccaccaagcccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31445 - RNA, 1341 nt, Artificial Sequence
  derived and/or modified sequence opt4 from Tositumomab_HeavyChain
caggccuaccugcagcagagcggcgccgagcuggugagacccggcgccagcgugaagaugagcugcaaggccagcggcuacaccuucaccagcuacaacaugcacugggugaagcagacccccagacagggccuggaguggaucggcgccaucuaccccggcaacggcgacaccagcuacaaccagaaguucaagggcaaggccacccugaccguggacaagagcagcagcaccgccuacaugcagcugagcagccugaccagcgaggacagcgccguguacuucugcgccagagugguguacuacagcaacagcuacugguacuucgacguguggggcaccggcaccaccgugaccgugagcggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggccgagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31446 - RNA, 630 nt, Artificial Sequence
  derived and/or modified sequence opt4 from Tositumomab_LightChain
cagaucgugcugagccagagccccgccauccugagcgccagccccggcgagaaggugaccaugaccugcagagccagcagcagcgugagcuacaugcacugguaccagcagaagcccggcagcagccccaagcccuggaucuacgcccccagcaaccuggccagcggcgugcccgccagauucagcggcagcggcagcggcaccagcuacagccugaccaucagcagaguggaggccgaggacgccgccaccuacuacugccagcaguggagcuucaacccccccaccuucggcgccggcaccaagcuggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacaga

SEQ ID NO: 31447 - RNA, 1338 nt, Artificial Sequence
  derived and/or modified sequence opt4 from Tovetumab_HeavyChain1
caggugcagcugguggagagcggcggcggccuggugaagcccggcggcagccugagacugagcugcgccgccagcggcuucaccuucagcgacuacuacaugaacuggaucagacaggcccccggcaagggccuggagugggugagcuacaucagcagcagcggcagcaucaucuacuacgccgacagcgugaagggcagauucaccaucagcagagacaacgccaagaacagccuguaccugcagaugaacagccugagagccgaggacaccgccguguacuacugcgccagagagggcagaaucgccgccagaggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31448 - RNA, 645 nt, Artificial Sequence
  derived and/or modified sequence opt4 from Tovetumab_LightChain1
gacauccagaugacccagagccccagcagccugagcgccagcgugggcgacagagugagcaucaccugcagacccagccagagcuucagcagauacaucaacugguaccagcagaagcccggcaaggcccccaagcugcugauccacgccgccagcagccuggugggcggcgugcccagcagauucagcggcagcggcagcggcaccgacuucacccugaccaucagcagccugcagcccgaggacuucgccaccuacuacugccagcagaccuacagcaacccccccaucaccuucggccagggcaccagacuggagaugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31449 - RNA, 1347 nt, Artificial Sequence
  derived and/or modified sequence opt4 from Tralokinumab_HeavyChain1
caggugcagcuggugcagagcggcgccgaggugaagaagcccggcgccagcgugaaggugagcugcaaggccagcggcuacaccuucaccaacuacggccugagcugggugagacaggcccccggccagggccuggaguggaugggcuggaucagcgccaacaacggcgacaccaacuacggccaggaguuccagggcagagugaccaugaccaccgacaccagcaccagcaccgccuacauggagcugagaagccugagaagcgacgacaccgccguguacuacugcgccagagacagcagcagcagcugggccagaugguucuucgaccuguggggcagaggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31450 - RNA, 642 nt, Artificial Sequence
  derived and/or modified sequence opt4 from Tralokinumab_LightChain1
agcuacgugcugacccagccccccagcgugagcguggcccccggcaagaccgccagaaucaccugcggcggcaacaucaucggcagcaagcuggugcacugguaccagcagaagcccggccaggcccccgugcuggugaucuacgacgacggcgacagacccagcggcauccccgagagauucagcggcagcaacagcggcaacaccgccacccugaccaucagcagaguggaggccggcgacgaggccgacuacuacugccaggugugggacaccggcagcgaccccgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31451 - RNA, 1332 nt, Artificial Sequence
  derived and/or modified sequence opt4 from Trastuzuab_HeavyChain1
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaacagccugagagccgaggacaccgccguguacuacugcagcagauggggcggcgacggcuucuacgccgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggc

SEQ ID NO: 31452 - RNA, 639 nt, Artificial Sequence
  derived and/or modified sequence opt4 from Trastuzuab_LightChain1
gacauccagacccagagccccagcagccugagcgccagcgugggcgacagagugaccaucaccugcagagccagccaggacgugaacaccgccguggccugguaccagcagaagcccggcaaggcccccaagcugcugaucuacagcgccagcuuccuguacagcggcgugcccagcagauucagcggcagcagaagcggcaccgacuucacccugaccaucagcagccugcagcccgaggacuucgccaccuacuacugccagcagcacuacaccaccccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31453 - RNA, 1347 nt, Artificial Sequence
  derived and/or modified sequence opt4 from Trastuzumab_emtansine_HeavyChain1
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaugaacagccugagagccgaggacaccgccguguacuacugcagcagauggggcggcgacggcuucuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31454 - RNA, 642 nt, Artificial Sequence; identical to SEQ ID NO: 31310
  derived and/or modified sequence opt4 from Trastuzumab_emtansine_LightChain1

SEQ ID NO: 31455 - RNA, 1347 nt, Artificial Sequence; identical to SEQ ID NO: 31453
  derived and/or modified sequence opt4 from Trastuzumab_HeavyChain1

SEQ ID NO: 31456 - RNA, 1353 nt, Artificial Sequence
  derived and/or modified sequence opt4 from Trastuzumab_HeavyChain
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaugaacagccugagagccgaggacaccgccguguacuacugcagcagauggggcggcgacggcuucuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagccccccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31457 - RNA, 660 nt, Artificial Sequence
  derived and/or modified sequence opt4 from Trastuzumab_HeavyChain_variant_1n8z_B
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaugaacagccugagagccgaggacaccgccguguacuacugcagcagauggggcggcgacggcuucuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagccc

SEQ ID NO: 31458 - RNA, 45 nt, Artificial Sequence
  derived and/or modified sequence opt4 from Trastuzumab_HeavyChain_variant_7637_H
gagcccaagagcugcgacaagacccacaccugcccccccugcccc

SEQ ID NO: 31459 - RNA, 642 nt, Artificial Sequence; identical to SEQ ID NO: 31310
  derived and/or modified sequence opt4 from Trastuzumab_LightChain1

SEQ ID NO: 31460 - RNA, 642 nt, Artificial Sequence; identical to SEQ ID NO: 31310
  derived and/or modified sequence opt4 from Trastuzumab_LightChain_variant_1n8z_A

SEQ ID NO: 31461 - RNA, 642 nt, Artificial Sequence; identical to SEQ ID NO: 31310
  derived and/or modified sequence opt4 from Trastuzumab_LightChain_variant_7637_L

SEQ ID NO: 31462 - RNA, 1344 nt, Artificial Sequence
  derived and/or modified sequence opt4 from TRC-105_HeavyChain1
gaggugaagcuggaggagagcggcggcggccuggugcagcccggcggcagcaugaagcugagcugcgccgccagcggcuucaccuucagcgacgccuggauggacugggugagacagagccccgagaagggccuggaguggguggccgagaucagaagcaaggccagcaaccacgccaccuacuacgccgagagcgugaagggcagauucaccaucagcagagacgacagcaagagcagcguguaccugcagaugaacagccugagagccgaggacaccggcaucuacuacugcaccagauggagaagauucuucgacagcuggggccagggcaccacccugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31463 - RNA, 639 nt, Artificial Sequence
  derived and/or modified sequence opt4 from TRC-105_LightChain1
cagaucgugcugagccagagccccgccauccugagcgccagccccggcgagaaggugaccaugaccugcagagccagcagcagcgugagcuacaugcacugguaccagcagaagcccggcagcagccccaagcccuggaucuacgccaccagcaaccuggccagcggcgugcccgugagauucagcggcagcggcagcggcaccagcuacagccugaccaucagcagaguggaggccgaggacgccgccaccuacuacugccagcaguggagcagcaacccccugaccuucggcgccggcaccaagcuggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31464 - RNA, 1362 nt, Artificial Sequence
  derived and/or modified sequence opt4 from Tregalizumab_HeavyChain1
gaggagcagcugguggagagcggcggcggccuggugaagcccggcggcagccugagacugagcugcgccgccagcggcuucagcuucagcgacugcagaauguacuggcugagacaggcccccggcaagggccuggaguggaucggcgugaucagcgugaagagcgagaacuacggcgccaacuacgccgagagcgugagaggcagauucaccaucagcagagacgacagcaagaacaccguguaccugcagaugaacagccugaagaccgaggacaccgccguguacuacugcagcgccagcuacuacagauacgacgugggcgccugguucgccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31465 - RNA, 654 nt, Artificial Sequence
  derived and/or modified sequence opt4 from Tregalizumab_LightChain1
gacaucgugaugacccagagccccgacagccuggccgugagccugggcgagagagccaccaucaacugcagagccagcaagagcgugagcaccagcggcuacagcuacaucuacugguaccagcagaagcccggccagccccccaagcugcugaucuaccuggccagcauccuggagagcggcgugcccgacagauucagcggcagcggcagcggcaccgacuucacccugaccaucagcagccugcaggccgaggacguggccguguacuacugccagcacagcagagagcugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31466 - RNA, 1353 nt, Artificial Sequence
  derived and/or modified sequence opt4 from Tremelimumab_HeavyChain1
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucugguacgacggcagcaacaaguacuacgccgacagcgugaagggcagauucaccaucagcagagacaacagcaagaacacccuguaccugcagaugaacagccugagagccgaggacaccgccguguacuacugcgccagagaccccagaggcgccacccuguacuacuacuacuacggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31467 - RNA, 642 nt, Artificial Sequence
  derived and/or modified sequence opt4 from Tremelimumab_LightChain1
gacauccagaugacccagagccccagcagccugagcgccagcgugggcgacagagugaccaucaccugcagagccagccagagcaucaacagcuaccuggacugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcaguacuacagcacccccuucaccuucggccccggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31468 - RNA, 1341 nt, Artificial Sequence
  derived and/or modified sequence opt4 from Trevogrumab_HeavyChain1
gaggugcaggugcuggagagcggcggcgaccuggugcagcccggcggcagccugagacugagcugcgccgccagcggcuucaccuucagcgccuacgccaugaccugggugagacaggcccccggcaagggccuggagugggugagcgccaucagcggcagcggcggcagcgccuacuacgccgacagcgugaagggcagauucaccaucagcagagacaacagcaagaacaccguguaccugcagaugaacagccugagagccgaggacaccgccguguacuacugcgccaaggacggcgccuggaagaugagcggccuggacguguggggccagggcaccaccgugaucgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31469 - RNA, 642 nt, Artificial Sequence
  derived and/or modified sequence opt4 from Trevogrumab_LightChain1
gacauccagaugacccagagccccgccagccugagcgccagcgugggcgacagagugaccaucaccugcagagccagccaggacaucagcgacuaccuggccugguaccagcagaagcccggcaagauccccagacugcugaucuacaccaccagcacccugcagagcggcgugcccagcagauucagaggcagcggcagcggcaccgacuucacccugaccaucagcagccugcagcccgaggacguggccaccuacuacugccagaaguacgacagcgccccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31470 - RNA, 1737 nt, Artificial Sequence
  derived and/or modified sequence opt4 from Tucotuzumab_celmoleukin_HeavyChain1
cagauccagcuggugcagagcggcgccgaggugaagaagcccggcgagaccgugaagaucagcugcaaggccagcggcuacaccuucaccaacuacggcaugaacugggugaagcagacccccggcaagggccugaaguggaugggcuggaucaacaccuacaccggcgagcccaccuacgccgacgacuucaagggcagauucgccuucagccuggagaccagcaccagcaccgccuuccugcagaucaacaaccugagaagcgaggacaccgccaccuacuucugcgugagauucaucagcaagggcgacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaaggcccccaccagcagcagcaccaagaagacccagcugcagcuggagcaccugcugcuggaccugcagaugauccugaacggcaucaacaacuacaagaaccccaagcugaccagaaugcugaccuucaaguucuacaugcccaagaaggccaccgagcugaagcaccugcagugccuggaggaggagcugaagccccuggaggaggugcugaaccuggcccagagcaagaacuuccaccugagacccagagaccugaucagcaacaucaacgugaucgugcuggagcugaagggcagcgagaccaccuucaugugcgaguacgccgacgagaccgccaccaucguggaguuccugaacagauggaucaccuucugccagagcaucaucagcacccugacc

SEQ ID NO: 31471 - RNA, 639 nt, Artificial Sequence
  derived and/or modified sequence opt4 from Tucotuzumab_celmoleukin_LightChain1
gagaucgugcugacccagagccccgccacccugagccugagccccggcgagagagugacccugaccugcagcgccagcagcagcgugagcuacaugcugugguaccagcagaagcccggcagcagccccaagcccuggaucuucgacaccagcaaccuggccagcggcuuccccgccagauucagcggcagcggcagcggcaccagcuacagccugaucaucagcagcauggaggccgaggacgccgccaccuacuacugccaccagagaagcggcuaccccuacaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31472 - RNA, 1344 nt, Artificial Sequence
  derived and/or modified sequence opt4 from Ublituximab_HeavyChain1
caggccuaccugcagcagagcggcgccgagcuggugagacccggcgccagcgugaagaugagcugcaaggccagcggcuacaccuucaccagcuacaacaugcacugggugaagcagacccccagacagggccuggaguggaucggcggcaucuaccccggcaacggcgacaccagcuacaaccagaaguucaagggcaaggccacccugaccgugggcaagagcagcagcaccgccuacaugcagcugagcagccugaccagcgaggacagcgccguguacuucugcgccagauacgacuacaacuacgccauggacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31473 - RNA, 639 nt, Artificial Sequence
  derived and/or modified sequence opt4 from Ublituximab_LightChain1
cagaucgugcugagccagagccccgccauccugagcgccagccccggcgagaaggugaccaugaccugcagagccagcagcagcgugagcuacaugcacugguaccagcagaagcccggcagcagccccaagcccuggaucuacgccaccagcaaccuggccagcggcgugcccgccagauucagcggcagcggcagcggcaccagcuacagcuucaccaucagcagaguggaggccgaggacgccgccaccuacuacugccagcaguggaccuucaacccccccaccuucggcggcggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31474 - RNA, 1353 nt, Artificial Sequence
  derived and/or modified sequence opt4 from Ulocuplumab_HeavyChain1
gaggugcagcugguggagagcggcggcggccuggugcagcccggcggcagccugagacugagcugcgccgccgccggcuucaccuucagcagcuacagcaugaacugggugagacaggcccccggcaagggccuggagugggugagcuacaucagcagcagaagcagaaccaucuacuacgccgacagcgugaagggcagauucaccaucagcagagacaacgccaagaacagccuguaccugcagaugaacagccugagagacgaggacaccgccguguacuacugcgccagagacuacggcggccagccccccuacuacuacuacuacggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 31475 - RNA, 642 nt, Artificial Sequence
  derived and/or modified sequence opt4 from Ulocuplumab_LightChain1
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgugaccuacuacugccagcaguacaacagcuaccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31476 - RNA, 1344 nt, Artificial Sequence
  derived and/or modified sequence opt4 from Urelumab_HeavyChain1
caggugcagcugcagcaguggggcgccggccugcugaagcccagcgagacccugagccugaccugcgccguguacggcggcagcuucagcggcuacuacuggagcuggaucagacagagccccgagaagggccuggaguggaucggcgagaucaaccacggcggcuacgugaccuacaaccccagccuggagagcagagugaccaucagcguggacaccagcaagaaccaguucagccugaagcugagcagcgugaccgccgccgacaccgccguguacuacugcgccagagacuacggccccggcaacuacgacugguacuucgaccuguggggcagaggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31477 - RNA, 648 nt, Artificial Sequence
  derived and/or modified sequence opt4 from Urelumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggccccccgcccugaccuucugcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31478 - RNA, 1347 nt, Artificial Sequence
  derived and/or modified sequence opt4 from Urtoxazumab_HeavyChain1
gaggugcagcugguggagagcggcggcggccuggugcagcccggcggcagccugagacugagcugcgccgccagcggcuucaccuucagcagcuacggcaugagcugggugagacaggcccccggcaagggccuggaguggguggccaccaucagcaccggcggcagcuacaccuacuaccccgacagcgugaagggcagauucaccaucagcagagacaacgccaagaacacccuguaccugcagaugaacagccugagagccgaggacaccgccguguacuacugcgccagaagaggcgacgccuggggcaaccuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31479 - RNA, 642 nt, Artificial Sequence
  derived and/or modified sequence opt4 from Urtoxazumab_LightChain1
gagaucgugcugacccagagccccgccacccugagcgugagccccggcgagagagccacccugagcugcagagccagccagaccaucagcaacaaccugcacugguaccagcagaagcccggccaggcccccagacugcugaucaagagcgccagccagagcaucagcggcauccccgccagauucagcggcagcggcagcggcaccgacuucacccugaccaucagcagccuggagagcgaggacuucgccguguacuacugccagcagagcuacagcuggccccugaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31480 - RNA, 1347 nt, Artificial Sequence
  derived and/or modified sequence opt4 from Ustekinumab_HeavyChain1
gaggugcagcuggugcagagcggcgccgaggugaagaagcccggcgagagccugaagaucagcugcaagggcagcggcuacagcuucaccaccuacuggcugggcugggugagacagaugcccggcaagggccuggacuggaucggcaucaugagccccguggacagcgacaucagauacagccccagcuuccagggccaggugaccaugagcguggacaagagcaucaccaccgccuaccugcaguggaacagccugaaggccagcgacaccgccauguacuacugcgccagaagaagacccggccagggcuacuucgacuucuggggccagggcacccuggugaccgugagcagcagcagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31481 - RNA, 642 nt, Artificial Sequence
  derived and/or modified sequence opt4 from Ustekinumab_LightChain1
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacaucuaccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31482 - RNA, 1341 nt, Artificial Sequence
  derived and/or modified sequence opt4 from Vadastuximab_talirine_HeavyChain1
caggugcagcuggugcagagcggcgccgaggugaagaagcccggcgccagcgugaaggugagcugcaaggccagcggcuacaccuucaccaacuacgacaucaacugggugagacaggcccccggccagggccuggaguggaucggcuggaucuaccccggcgacggcagcaccaaguacaacgagaaguucaaggccaaggccacccugaccgccgacaccagcaccagcaccgccuacauggagcugagaagccugagaagcgacgacaccgccguguacuacugcgccagcggcuacgaggacgccauggacuacuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccugcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31483 - RNA, 642 nt, Artificial Sequence
  derived and/or modified sequence opt4 from Vadastuximab_talirine_LightChain1
gacauccagaugacccagagccccagcagccugagcgccagcgugggcgacagagugaccaucaacugcaaggccagccaggacaucaacagcuaccugagcugguuccagcagaagcccggcaaggcccccaagacccugaucuacagagccaacagacugguggacggcgugcccagcagauucagcggcagcggcagcggccaggacuacacccugaccaucagcagccugcagcccgaggacuucgccaccuacuacugccugcaguacgacgaguucccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31484 - RNA, 1362 nt, Artificial Sequence
  derived and/or modified sequence opt4 from Vandortuzumab_vedotin_HeavyChain1
gaggugcagcugguggagagcggcggcggccuggugcagcccggcggcagccugagacugagcugcgccgugagcggcuacagcaucaccagcgacuacgccuggaacugggugagacaggcccccggcaagggccuggagugggugggcuacaucagcaacagcggcagcaccagcuacaaccccagccugaagagcagauucaccaucagcagagacaccagcaagaacacccuguaccugcagaugaacagccugagagccgaggacaccgccguguacuacugcgccagagagagaaacuacgacuacgacgacuacuacuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31485 - RNA, 660 nt, Artificial Sequence
  derived and/or modified sequence opt4 from Vandortuzumab_vedotin_LightChain1
gacauccagaugacccagagccccagcagccugagcgccagcgugggcgacagagugaccaucaccugcaagagcagccagagccugcuguacagaagcaaccagaagaacuaccuggccugguaccagcagaagcccggcaaggcccccaagcugcugaucuacugggccagcaccagagagagcggcgugcccagcagauucagcggcagcggcagcggcaccgacuucacccugaccaucagcagccugcagcccgaggacuucgccaccuacuacugccagcaguacuacaacuaccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31486 - RNA, 1329 nt, Artificial Sequence
  derived and/or modified sequence opt4 from Vantictumab_HeavyChain1
gaggugcagcugguggagagcggcggcggccuggugcagcccggcggcagccugagacugagcugcgccgccagcggcuucaccuucagccacuacacccugagcugggugagacaggcccccggcaagggccuggagugggugagcgugaucagcggcgacggcagcuacaccuacuacgccgacagcgugaagggcagauucaccaucagcagcgacaacagcaagaacacccuguaccugcagaugaacagccugagagccgaggacaccgccguguacuacugcgccagaaacuucaucaaguacguguucgccaacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31487 - RNA, 639 nt, Artificial Sequence
  derived and/or modified sequence opt4 from Vantictumab_LightChain1
gacaucgagcugacccagccccccagcgugagcguggcccccggccagaccgccagaaucagcugcagcggcgacaacaucggcagcuucuacgugcacugguaccagcagaagcccggccaggcccccgugcuggugaucuacgacaagagcaacagacccagcggcauccccgagagauucagcggcagcaacagcggcaacaccgccacccugaccaucagcggcacccaggccgaggacgaggccgacuacuacugccagagcuacgccaacacccugagccugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31488 - RNA, 1389 nt, Artificial Sequence
  derived and/or modified sequence opt4 from Vanucizumab_HeavyChain1
caggugcagcuggugcagagcggcgccgaggugaagaagcccggcgccagcgugaaggugagcugcaaggccagcggcuacaccuucaccggcuacuacaugcacugggugagacaggcccccggccagggccuggaguggaugggcuggaucaaccccaacagcggcggcaccaacuacgcccagaaguuccagggcagagugaccaugaccagagacaccagcaucagcaccgccuacauggagcugagcagacugagaagcgacgacaccgccguguacuacugcgccagaagccccaaccccuacuacuacgacagcagcggcuacuacuaccccggcgccuucgacaucuggggccagggcaccauggugaccgugagcagcgccagcguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccaggugugcacccugccccccagcagagacgagcugaccaagaaccaggugagccugagcugcgccgugaagggcuucuaccccagcgacaucgccguggagugggagagcaacggccagcccgagaacaacuacaagaccaccccccccgugcuggacagcgacggcagcuucuuccuggugagcaagcugaccguggacaagagcagauggcagcagggcaacguguucagcugcagcgugaugcacgaggcccugcacaaccacuacacccagaagagccugagccugagccccggcaag

SEQ ID NO: 31489 - RNA, 1359 nt, Artificial Sequence
  derived and/or modified sequence opt4 from Vanucizumab_HeavyChain2
gaggugcagcugguggagagcggcggcggccuggugcagcccggcggcagccugagacugagcugcgccgccagcggcuacaccuucaccaacuacggcaugaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaugaacagccugagagccgaggacaccgccguguacuacugcgccaaguacccccacuacuacggcagcagccacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccugcagagacgagcugaccaagaaccaggugagccuguggugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31490 - RNA, 639 nt, Artificial Sequence
  derived and/or modified sequence opt4 from Vanucizumab_LightChain1
cagcccggccugacccagccccccagcgugagcguggcccccggccagaccgccagaaucaccugcggcggcaacaacaucggcagcaagagcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacuacguguucggcaccggcaccaaggugaccgugcugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 31491 - RNA, 642 nt, Artificial Sequence; identical to SEQ ID NO: 30652
  derived and/or modified sequence opt4 from Vanucizumab_LightChain2

SEQ ID NO: 31492 - RNA, 1356 nt, Artificial Sequence
  derived and/or modified sequence opt4 from Varlilumab_HeavyChain1
caggugcagcugguggagagcggcggcggcguggugcagcccggcagaagccugagacugagcugcgccgccagcggcuucaccuucagcagcuacgacaugcacugggugagacaggcccccggcaagggccuggaguggguggccgugaucugguacgacggcagcaacaaguacuacgccgacagcgugaagggcagauucaccaucagcagagacaacagcaagaacacccuguaccugcagaugaacagccugagagccgaggacaccgccguguacuacugcgccagaggcagcggcaacuggggcuucuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaagggcagcagc

SEQ ID NO: 31493 - RNA, 642 nt, Artificial Sequence
  derived and/or modified sequence opt4 from Varlilumab_LightChain1
gacauccagaugacccagagccccagcagccugagcgccagcgugggcgacagagugaccaucaccugcagagccagccagggcaucagcagauggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacaccuaccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31494 - RNA, 1338 nt, Artificial Sequence
  derived and/or modified sequence opt4 from Vatelizumab_HeavyChain1
caggugcagcugcaggagagcggccccggccuggugaagcccagcgagacccugagccugaccugcaccgugagcggcuucagccugaccaacuacggcauccacuggaucagacagccccccggcaagggccuggaguggcugggcgugaucugggccagaggcuucaccaacuacaacagcgcccugaugagcagacugaccaucagcaaggacaacagcaagaaccaggugagccugaagcugagcagcgugaccgccgccgacaccgccguguacuacugcgccagagccaacgacggcguguacuacgccauggacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31495 - RNA, 639 nt, Artificial Sequence
  derived and/or modified sequence opt4 from Vatelizumab_LightChain1
gacuucgugaugacccagagccccgccuuccugagcgugacccccggcgagaaggugaccaucaccugcagcgcccagagcagcgugaacuacauccacugguaccagcagaagcccgaccaggcccccaagaagcugaucuacgacaccagcaagcuggccagcggcgugcccagcagauucagcggcagcggcagcggcaccgacuacaccuucaccaucagcagccuggaggccgaggacgccgccaccuacuacugccagcaguggaccaccaacccccugaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31496 - RNA, 1353 nt, Artificial Sequence
  derived and/or modified sequence opt4 from Vedolizumab_HeavyChain1
caggugcagcuggugcagagcggcgccgaggugaagaagcccggcgccagcgugaaggugagcugcaagggcagcggcuacaccuucaccagcuacuggaugcacugggugagacaggcccccggccagagacuggaguggaucggcgagaucgaccccagcgagagcaacaccaacuacaaccagaaguucaagggcagagugacccugaccguggacaucagcgccagcaccgccuacauggagcugagcagccugagaagcgaggacaccgccguguacuacugcgccagaggcggcuacgacggcugggacuacgccaucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcuggccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31497 - RNA, 657 nt, Artificial Sequence
  derived and/or modified sequence opt4 from Vedolizumab_LightChain1
gacguggugaugacccagagcccccugagccugcccgugacccccggcgagcccgccagcaucagcugcagaagcagccagagccuggccaagagcuacggcaacaccuaccugagcugguaccugcagaagcccggccagagcccccagcugcugaucuacggcaucagcaacagauucagcggcgugcccgacagauucagcggcagcggcagcggcaccgacuucacccugaagaucagcagaguggaggccgaggacgugggcguguacuacugccugcagggcacccaccagcccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31498 - RNA, 1353 nt, Artificial Sequence
  derived and/or modified sequence opt4 from Veltuzumab_HeavyChain1
caggugcagcugcagcagagcggcgccgaggugaagaagcccggcagcagcgugaaggugagcugcaaggccagcggcuacaccuucaccagcuacaacaugcacugggugaagcaggcccccggccagggccuggaguggaucggcgccaucuaccccggcaugggcgacaccagcuacaaccagaaguucaagggcaaggccacccugaccgccgacgagagcaccaacaccgccuacauggagcugagcagccugagaagcgaggacaccgccuucuacuacugcgccagaagcaccuacuacggcggcgacugguacuucgacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31499 - RNA, 639 nt, Artificial Sequence
  derived and/or modified sequence opt4 from Veltuzumab_LightChain1
gacauccagcugacccagagccccagcagccugagcgccagcgugggcgacagagugaccaugaccugcagagccagcagcagcgugagcuacauccacugguuccagcagaagcccggcaaggcccccaagcccuggaucuacgccaccagcaaccuggccagcggcgugcccgugagauucagcggcagcggcagcggcaccgacuacaccuucaccaucagcagccugcagcccgaggacaucgccaccuacuacugccagcaguggaccagcaacccccccaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31500 - RNA, 1359 nt, Artificial Sequence
  derived and/or modified sequence opt4 from Vesencumab_HeavyChain1
gaggugcagcugguggagagcggcggcggccuggugcagcccggcggcagccugagacugagcugcgccgccagcggcuucaccuucagcagcuacgccaugagcugggugagacaggcccccggcaagggccuggagugggugagccagaucagccccgccggcggcuacaccaacuacgccgacagcgugaagggcagauucaccaucagcgccgacaccagcaagaacaccgccuaccugcagaugaacagccugagagccgaggacaccgccguguacuacugcgccagaggcgagcugcccuacuacagaaugagcaaggugauggacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31501 - RNA, 642 nt, Artificial Sequence
  derived and/or modified sequence opt4 from Vesencumab_LightChain1
gacauccagaugacccagagccccagcagccugagcgccagcgugggcgacagagugaccaucaccugcagagccagccaguacuucagcagcuaccuggccugguaccagcagaagcccggcaaggcccccaagcugcugaucuacggcgccagcagcagagccagcggcgugcccagcagauucagcggcagcggcagcggcaccgacuucacccugaccaucagcagccugcagcccgaggacuucgccaccuacuacugccagcaguaccugggcagcccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31502 - RNA, 1338 nt, Artificial Sequence
  derived and/or modified sequence opt4 from Visilizumab_HeavyChain1
caggugcagcuggugcagagcggcgccgaggugaagaagcccggcgccagcgugaaggugagcugcaaggccagcggcuacaccuucaucagcuacaccaugcacugggugagacaggcccccggccagggccuggaguggaugggcuacaucaaccccagaagcggcuacacccacuacaaccagaagcugaaggacaaggccacccugaccgccgacaagagcgccagcaccgccuacauggagcugagcagccugagaagcgaggacaccgccguguacuacugcgccagaagcgccuacuacgacuacgacggcuucgccuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccgccgccgcccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccagcaag

SEQ ID NO: 31503 - RNA, 639 nt, Artificial Sequence
  derived and/or modified sequence opt4 from Visilizumab_LightChain1
gacauccagaugacccagagccccagcagccugagcgccagcgugggcgacagagugaccaucaccugcagcgccagcagcagcgugagcuacaugaacugguaccagcagaagcccggcaaggcccccaagagacugaucuacgacaccagcaagcuggccagcggcgugcccagcagauucagcggcagcggcagcggcaccgacuucacccugaccaucagcagccugcagcccgaggacuucgccaccuacuacugccagcaguggagcagcaacccccccaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31504 - RNA, 1353 nt, Artificial Sequence
  derived and/or modified sequence opt4 from Volociximab_HeavyChain
caggugcagcugaaggagagcggccccggccugguggcccccagccagagccugagcaucaccugcaccaucagcggcuucagccugaccgacuacggcgugcacugggugagacagccccccggcaagggccuggaguggcugguggugaucuggagcgacggcagcagcaccuacaacagcgcccugaagagcagaaugaccaucagaaaggacaacagcaagagccagguguuccugaucaugaacagccugcagaccgacgacagcgccauguacuacugcgccagacacggcaccuacuacggcaugaccaccaccggcgacgcccuggacuacuggggccagggcaccagcgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31505 - RNA, 645 nt, Artificial Sequence
  derived and/or modified sequence opt4 from Volociximab_LightChain
cagaucgugcugacccagagccccgccaucaugagcgccagccugggcgagagagugaccaugaccugcaccgccagcagcagcgugagcagcaacuaccugcacugguaccagcagaagcccggcagcgcccccaaccuguggaucuacagcaccagcaaccuggccagcggcgugcccgccagauucagcggcagcggcagcggcaccagcuacagccugaccaucagcagcauggaggccgaggacgccgccaccuacuacugccaccaguaccugagaagcccccccaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31506 - RNA, 1344 nt, Artificial Sequence
  derived and/or modified sequence opt4 from Vorsetuzumab_HeavyChain1
caggugcagcuggugcagagcggcgccgaggugaagaagcccggcgccagcgugaaggugagcugcaaggccagcggcuacaccuucaccaacuacggcaugaacugggugagacaggcccccggccagggccugaaguggaugggcuggaucaacaccuacaccggcgagcccaccuacgccgacgccuucaagggcagagugaccaugaccagagacaccagcaucagcaccgccuacauggagcugagcagacugagaagcgacgacaccgccguguacuacugcgccagagacuacggcgacuacggcauggacuacuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31507 - RNA, 654 nt, Artificial Sequence
  derived and/or modified sequence opt4 from Vorsetuzumab_LightChain1
gacaucgugaugacccagagccccgacagccuggccgugagccugggcgagagagccaccaucaacugcagagccagcaagagcgugagcaccagcggcuacagcuucaugcacugguaccagcagaagcccggccagccccccaagcugcugaucuaccuggccagcaaccuggagagcggcgugcccgacagauucagcggcagcggcagcggcaccgacuucacccugaccaucagcagccugcaggccgaggacguggccguguacuacugccagcacagcagagaggugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31508 - RNA, 1344 nt, Artificial Sequence; identical to SEQ ID NO: 31506
  derived and/or modified sequence opt4 from Vorsetuzumab_mafodotin_HeavyChain1

SEQ ID NO: 31509 - RNA, 654 nt, Artificial Sequence; identical to SEQ ID NO: 31507
  derived and/or modified sequence opt4 from Vorsetuzumab_mafodotin_LightChain1

SEQ ID NO: 31510 - RNA, 1347 nt, Artificial Sequence; identical to SEQ ID NO: 30732
  derived and/or modified sequence opt4 from Yttrium_(90Y)_clivatuzumab_tetraxetan_HeavyChain1

SEQ ID NO: 31511 - RNA, 645 nt, Artificial Sequence; identical to SEQ ID NO: 30733
  derived and/or modified sequence opt4 from Yttrium_(90Y)_clivatuzumab_tetraxetan_LightChain1

SEQ ID NO: 31512 - RNA, 1338 nt, Artificial Sequence
  derived and/or modified sequence opt4 from Yttrium_Y_90_epratuzumab_tetraxetan_HeavyChain1
caggugcagcuggugcagagcggcgccgaggugaagaagcccggcagcagcgugaaggugagcugcaaggccagcggcuacaccuucaccagcuacuggcugcacugggugagacaggcccccggccagggccuggaguggaucggcuacaucaaccccagaaacgacuacaccgaguacaaccagaacuucaaggacaaggccaccaucaccgccgacgagagcaccaacaccgccuacauggagcugagcagccugagaagcgaggacaccgccuucuacuucugcgccagaagagacaucaccaccuucuacuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31513 - RNA, 657 nt, Artificial Sequence
  derived and/or modified sequence opt4 from Yttrium_Y_90_epratuzumab_tetraxetan_LightChain1
gacauccagcugacccagagccccagcagccugagcgccagcgugggcgacagagugaccaugagcugcaagagcagccagagcgugcuguacagcgccaaccacaagaacuaccuggccugguaccagcagaagcccggcaaggcccccaagcugcugaucuacugggccagcaccagagagagcggcgugcccagcagauucagcggcagcggcagcggcaccgacuucaccuucaccaucagcagccugcagcccgaggacaucgccaccuacuacugccaccaguaccugagcagcuggaccuucggcggcggcaccaaggugcagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31514 - RNA, 1326 nt, Artificial Sequence
  derived and/or modified sequence opt4 from Yttrium_Y_90_epratuzumab_HeavyChain1
caggugcagcuggugcagagcggcgccgaggugaagaagcccggcagcagcgugaaggugagcugcaaggccagcggcuacaccuucaccagcuacuggcugcacugggugagacaggcccccggccagggccuggaguggaucggcuacaucaaccccagaaacgacuacaccgaguacaaccagaacuucaaggacaaggccaccaucaccgccgacgagagcaccaacaccgccuacgagcugagcagccugagaagcgaggacaccgccuucuacuucugcgccagaagagacaucaccaccuucuacuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggcaag

SEQ ID NO: 31515 - RNA, 654 nt, Artificial Sequence
  derived and/or modified sequence opt4 from Yttrium_Y_90_epratuzumab_LightChain1
gacauccagcugacccagagccccagcagccugagcgccagcgugggcgacagagugaccagcugcaagagcagccagagcgugcuguacagcgccaaccacaagaacuaccuggccugguaccagcagaagcccggcaaggcccccaagcugcugaucuacugggccagcaccagagagagcggcgugcccagcagauucagcggcagcggcagcggcaccgacuucaccuucaccaucagcagccugcagcccgaggacaucgccaccuacuacugccaccaguaccugagcagcuggaccuucggcggcggcaccaaggugcagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31516 - RNA, 1365 nt, Artificial Sequence
  derived and/or modified sequence opt4 from Zalutumumab_HeavyChain1
caggugcagcugguggagagcggcggcggcguggugcagcccggcagaagccugagacugagcugcgccgccagcggcuucaccuucagcaccuacggcaugcacugggugagacaggcccccggcaagggccuggaguggguggccgugaucugggacgacggcagcuacaaguacuacggcgacagcgugaagggcagauucaccaucagcagagacaacagcaagaacacccuguaccugcagaugaacagccugagagccgaggacaccgccguguacuacugcgccagagacggcaucaccauggugagaggcgugaugaaggacuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31517 - RNA, 642 nt, Artificial Sequence
  derived and/or modified sequence opt4 from Zalutumumab_LightChain1
gccauccagcugacccagagccccagcagccugagcgccagcgugggcgacagagugaccaucaccugcagagccagccaggacaucagcagcgcccuggugugguaccagcagaagcccggcaaggcccccaagcugcugaucuacgacgccagcagccuggagagcggcgugcccagcagauucagcggcagcgagagcggcaccgacuucacccugaccaucagcagccugcagcccgaggacuucgccaccuacuacugccagcaguucaacagcuacccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31518 - RNA, 1332 nt, Artificial Sequence
  derived and/or modified sequence opt4 from Zanolimumab_H0_HeavyChain
caggugcagcugcagcaguggggcgccggccugcugaagcccagcgagacccugagccugaccugcgccguguacggcggcagcuucagcggcuacuacuggagcuggaucagacagccccccggcaagggccuggaguggaucggcgagaucaaccacagcggcagcaccaacuacaaccccagccugaagagcagagugaccaucagcguggacaccagcaagaaccaguucagccugaagcugagcagcgugaccgccgccgacaccgccguguacuacugcgccagagugaucaacugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcuggaccgugcccagcagcagccugggcacccagaccuacaucugcaacgugaacuucaucaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcgugugggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31519 - RNA, 642 nt, Artificial Sequence
  derived and/or modified sequence opt4 from Zanolimumab_L0_LightChain
gacauccagaugacccagagccccagcagcgugagcgccagcgugggcgacagagugaccaucaccugcagagccagccaggacaucagcagcuggcuggccgugguguaccagcacaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcaggccaacagcuuccccuacaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaaguucaacagaggcgagugc

SEQ ID NO: 31520 - RNA, 1344 nt, Artificial Sequence; identical to SEQ ID NO: 31139
  derived and/or modified sequence opt4 from Zatuximab_HeavyChain1

SEQ ID NO: 31521 - RNA, 657 nt, Artificial Sequence; identical to SEQ ID NO: 31140
  derived and/or modified sequence opt4 from Zatuximab_LightChain1

SEQ ID NO: 31522 - RNA, 1356 nt, Artificial Sequence
  derived and/or modified sequence opt4 from Actoxumab_HeavyChain
caggugcagcugguggagagcggcggcggcguggugcagcccggcagaagccugagacugagcugcgccgccagcggcuucagcuucagcaacuacggcaugcacugggugagacaggcccccggcaagggccuggaguggguggcccugaucugguacgacggcagcaacgaggacuacaccgacagcgugaagggcagauucaccaucagcagagacaacagcaagaacacccuguaccugcagaugaacagccugagagccgaggacaccgccguguacuacugcgccagauggggcauggugagaggcgugaucgacguguucgacaucuggggccagggcaccguggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31523 - RNA, 642 nt, Artificial Sequence
  derived and/or modified sequence opt4 from Actoxumab_LightChain
gacauccagaugacccagagccccagcagcgugagcgccagcgugggcgacagagugaccaucaccugcagagccagccagggcaucagcagcuggcuggccugguaccagcacaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcaggccaacagcuuccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31524 - RNA, 1326 nt, Artificial Sequence
  derived and/or modified sequence opt4 from Andecaliximab_HeavyChain
caggugcagcugcaggagagcggccccggccuggugaagcccagcgagacccugagccugaccugcaccgugagcggcuucagccugcugagcuacggcgugcacugggugagacagccccccggcaagggccuggaguggcugggcgugaucuggaccggcggcaccaccaacuacaacagcgcccugaugagcagauucaccaucagcaaggacgacagcaagaacaccguguaccugaagaugaacagccugaagaccgaggacaccgccaucuacuacugcgccagauacuacuacggcauggacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31525 - RNA, 642 nt, Artificial Sequence
  derived and/or modified sequence opt4 from Andecaliximab_LightChain
gacauccagaugacccagagccccagcagccugagcgccagcgugggcgacagagugaccaucaccugcaaggccagccaggacgugagaaacaccguggccugguaccagcagaagcccggcaaggcccccaagcugcugaucuacagcagcagcuacagaaacaccggcgugcccgacagauucagcggcagcggcagcggcaccgacuucacccugaccaucagcagccugcaggccgaggacguggccguguacuacugccagcagcacuacaucacccccuacaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31526 - RNA, 1353 nt, Artificial Sequence
  derived and/or modified sequence opt4 from Aprutumab_HeavyChain
gaggugcagcugcuggagagcggcggcggccuggugcagcccggcggcagccugagacugagcugcgccgccagcggcuucaccuucagcagcuacgccaugagcugggugagacaggcccccggcaagggccuggagugggugagcgccaucagcggcagcggcaccagcaccuacuacgccgacagcgugaagggcagauucaccaucagcagagacaacagcaagaacacccuguaccugcagaugaacagccugagagccgaggacaccgccguguacuacugcgccagagugagauacaacuggaaccacggcgacugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31527 - RNA, 648 nt, Artificial Sequence
  derived and/or modified sequence opt4 from Aprutumab_LightChain
cagagcgugcugacccagccccccagcgccagcggcacccccggccagagagugaccaucagcugcagcggcagcagcagcaacaucggcaacaacuacgugagcugguaccagcagcugcccggcaccgcccccaagcugcugaucuacgagaacuacaacagacccgccggcgugcccgacagauucagcggcagcaagagcggcaccagcgccagccuggccaucagcggccugagaagcgaggacgaggccgacuacuacugcagcagcugggacgacagccugaacuacuggguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31528 - RNA, 1341 nt, Artificial Sequence
  derived and/or modified sequence opt4 from Azintuxizumab_HeavyChain
gaggugcagcugguggagagcggcggcggccuggugcagcccggcggcagccugagacugagcugcgccgccagcggcuucaccuucagcgacuacuacauggccugggugagacaggcccccggcaagggccuggaguggguggccagcaucaacuacgacggcagcagcaccuacuacguggacagcgugaagggcagauucaccaucagcagagacaacgccaagaacagccuguaccugcagaugaacagccugagagccgaggacaccgccguguacuacugcgccagagacagaggcuacuacuucgacuacuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31529 - RNA, 660 nt, Artificial Sequence
  derived and/or modified sequence opt4 from Azintuxizumab_LightChain
gacguggugaugacccagaccccccugagccugagcgugacccccggccagcccgccagcaucagcugcagaagcagccagagccuggugcacagcaacggcaacaccuaccugcacugguaccugcagaagcccggccagagcccccagcugcugaucuacaaggugagcaacagauucagcggcgugcccgacagauucagcggcagcggcagcggcaccgacuucacccugaagaucagcagaguggaggccgaggacgugggcguguacuucugcagccagagcacccacgugccccccuucaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31530 - RNA, 366 nt, Artificial Sequence
  derived and/or modified sequence opt4 from Blinatumomab_HeavyChain1
caggugcagcugcagcagagcggcgccgagcuggugagacccggcagcagcgugaagaucagcugcaaggccagcggcuacgccuucagcagcuacuggaugaacugggugaagcagagacccggccagggccuggaguggaucggccagaucuggcccggcgacggcgacaccaacuacaacggcaaguucaagggcaaggccacccugaccgccgacgagagcagcagcaccgccuacaugcagcugagcagccuggccagcgaggacagcgccguguacuucugcgccagaagagagaccaccaccgugggcagauacuacuacgccauggacuacuggggccagggcaccaccgugaccgug

SEQ ID NO: 31531 - RNA, 363 nt, Artificial Sequence
  derived and/or modified sequence opt4 from Blinatumomab_HeavyChain2
gacaucaagcugcagcagagcggcgccgagcuggccagacccggcgccagcgugaagaugagcugcaagaccagcggcuacaccuucaccagauacaccaugcacugggugaagcagagacccggccagggccuggaguggaucggcuacaucaaccccagcagaggcuacaccaacuacaaccagaaguucaaggacaaggccacccugaccaccgacaagagcagcagcaccgccuacaugcagcugagcagccugaccagcgaggacagcgccguguacuacugcgccagauacuacgacgaccacuacugccuggacuacuggggccagggcaccacccugaccgugagcagcguggag

SEQ ID NO: 31532 - RNA, 1494 nt, Artificial Sequence
  derived and/or modified sequence opt4 from Blinatumomab_LightChain_HeavyChain_HeavyChain_LightChain
gacauccagcugacccagagccccgccagccuggccgugagccugggccagagagccaccaucagcugcaaggccagccagagcguggacuacgacggcgacagcuaccugaacugguaccagcagauccccggccagccccccaagcugcugaucuacgacgccagcaaccuggugagcggcaucccccccagauucagcggcagcggcagcggcaccgacuucacccugaacauccaccccguggagaagguggacgccgccaccuaccacugccagcagagcaccgaggaccccuggaccuucggcggcggcaccaagcuggagaucaagggcggcggcggcagcggcggcggcggcagcggcggcggcggcagccaggugcagcugcagcagagcggcgccgagcuggugagacccggcagcagcgugaagaucagcugcaaggccagcggcuacgccuucagcagcuacuggaugaacugggugaagcagagacccggccagggccuggaguggaucggccagaucuggcccggcgacggcgacaccaacuacaacggcaaguucaagggcaaggccacccugaccgccgacgagagcagcagcaccgccuacaugcagcugagcagccuggccagcgaggacagcgccguguacuucugcgccagaagagagaccaccaccgugggcagauacuacuacgccauggacuacuggggccagggcaccaccgugaccgugagcagcggcggcggcggcagcgacaucaagcugcagcagagcggcgccgagcuggccagacccggcgccagcgugaagaugagcugcaagaccagcggcuacaccuucaccagauacaccaugcacugggugaagcagagacccggccagggccuggaguggaucggcuacaucaaccccagcagaggcuacaccaacuacaaccagaaguucaaggacaaggccacccugaccaccgacaagagcagcagcaccgccuacaugcagcugagcagccugaccagcgaggacagcgccguguacuacugcgccagauacuacgacgaccacuacugccuggacuacuggggccagggcaccacccugaccgugagcagcguggagggcggcagcggcggcagcggcggcagcggcggcagcggcggcguggacgacauccagcugacccagagccccgccaucaugagcgccagccccggcgagaaggugaccaugaccugcagagccagcagcagcgugagcuacaugaacugguaccagcagaagagcggcaccagccccaagagauggaucuacgacaccagcaagguggccagcggcgugcccuacagauucagcggcagcggcagcggcaccagcuacagccugaccaucagcagcauggaggccgaggacgccgccaccuacuacugccagcaguggagcagcaacccccugaccuucggcgccggcaccaagcuggagcugaag

SEQ ID NO: 31533 - RNA, 333 nt, Artificial Sequence
  derived and/or modified sequence opt4 from Blinatumomab_LightChain1
gacauccagcugacccagagccccgccagccuggccgugagccugggccagagagccaccaucagcugcaaggccagccagagcguggacuacgacggcgacagcuaccugaacugguaccagcagauccccggccagccccccaagcugcugaucuacgacgccagcaaccuggugagcggcaucccccccagauucagcggcagcggcagcggcaccgacuucacccugaacauccaccccguggagaagguggacgccgccaccuaccacugccagcagagcaccgaggaccccuggaccuucggcggcggcaccaagcuggagaucaag

SEQ ID NO: 31534 - RNA, 324 nt, Artificial Sequence
  derived and/or modified sequence opt4 from Blinatumomab_LightChain2
guggacgacauccagcugacccagagccccgccaucaugagcgccagccccggcgagaaggugaccaugaccugcagagccagcagcagcgugagcuacaugaacugguaccagcagaagagcggcaccagccccaagagauggaucuacgacaccagcaagguggccagcggcgugcccuacagauucagcggcagcggcagcggcaccagcuacagccugaccaucagcagcauggaggccgaggacgccgccaccuacuacugccagcaguggagcagcaacccccugaccuucggcgccggcaccaagcuggagcugaag

SEQ ID NO: 31535 - RNA, 1350 nt, Artificial Sequence
  derived and/or modified sequence opt4 from Brazikumab_HeavyChain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucugguacgacggcagcaacgaguacuacgccgacagcgugaagggcagauucaccaucagcagagacaacagcaagaacacccuguaccugcagaugaacagccugagagccgaggacaccgccguguacuacugcgccagagacagaggcuacaccagcagcugguaccccgacgccuucgacaucuggggccagggcaccauggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31536 - RNA, 651 nt, Artificial Sequence
  derived and/or modified sequence opt4 from Brazikumab_LightChain
cagagcgugcugacccagccccccagcgugagcggcgcccccggccagagagugaccaucagcugcaccggcagcagcagcaacaccggcgccggcuacgacgugcacugguaccagcaggugcccggcaccgcccccaagcugcugaucuacggcagcggcaacagacccagcggcgugcccgacagauucagcggcagcaagagcggcaccagcgccagccuggccaucaccggccugcaggccgaggacgaggccgacuacuacugccagagcuacgacagcagccugagcggcuggguguucggcggcggcaccagacugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31537 - RNA, 363 nt, Artificial Sequence
  derived and/or modified sequence opt4 from Brolucizumab_HeavyChain
agcgaggugcagcugguggagagcggcggcggccuggugcagcccggcggcagccugagacugagcugcaccgccagcggcuucagccugaccgacuacuacuacaugaccugggugagacaggcccccggcaagggccuggagugggugggcuucaucgaccccgacgacgaccccuacuacgccaccugggccaagggcagauucaccaucagcagagacaacagcaagaacacccuguaccugcagaugaacagccugagagccgaggacaccgccguguacuacugcgccggcggcgaccacaacagcggcuggggccuggacaucuggggccagggcacccuggugaccgugagcagc

SEQ ID NO: 31538 - RNA, 333 nt, Artificial Sequence
  derived and/or modified sequence opt4 from Brolucizumab_LightChain
auggagaucgugaugacccagagccccagcacccugagcgccagcgugggcgacagagugaucaucaccugccaggccagcgagaucauccacagcuggcuggccugguaccagcagaagcccggcaaggcccccaagcugcugaucuaccuggccagcacccuggccagcggcgugcccagcagauucagcggcagcggcagcggcgccgaguucacccugaccaucagcagccugcagcccgacgacuucgccaccuacuacugccagaacguguaccuggccagcaccaacggcgccaacuucggccagggcaccaagcugaccgugcug

SEQ ID NO: 31539 - RNA, 1347 nt, Artificial Sequence
  derived and/or modified sequence opt4 from Cabiralizumab_HeavyChain
caggugcagcuggugcagagcggcgccgaggugaagaagcccggcagcagcgugaaggugagcugcaaggccagcggcuacaccuucaccgacaacuacaugaucugggugagacaggcccccggccagggccuggaguggaugggcgacaucaaccccuacaacggcggcaccaccuucaaccagaaguucaagggcagagugaccaucaccgccgacaagagcaccagcaccgccuacauggagcugagcagccugagaagcgaggacaccgccguguacuacugcgccagagagagccccuacuucagcaaccuguacgugauggacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31540 - RNA, 654 nt, Artificial Sequence
  derived and/or modified sequence opt4 from Cabiralizumab_LightChain
gagaucgugcugacccagagccccgccacccugagccugagccccggcgagagagccacccugagcugcaaggccagccagagcguggacuacgacggcgacaacuacaugaacugguaccagcagaagcccggccaggcccccagacugcugaucuacgccgccagcaaccuggagagcggcauccccgccagauucagcggcagcggcagcggcaccgacuucacccugaccaucagcagccuggagcccgaggacuucgccguguacuacugccaccugagcaacgaggaccugagcaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31541 - RNA, 1329 nt, Artificial Sequence
  derived and/or modified sequence opt4 from Camrelizumab_HeavyChain
gaggugcagcugguggagagcggcggcggccuggugcagcccggcggcagccugagacugagcugcgccgccagcggcuucaccuucagcagcuacaugaugagcugggugagacaggcccccggcaagggccuggaguggguggccaccaucagcggcggcggcgccaacaccuacuaccccgacagcgugaagggcagauucaccaucagcagagacaacgccaagaacagccuguaccugcagaugaacagccugagagccgaggacaccgccguguacuacugcgccagacagcuguacuacuucgacuacuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31542 - RNA, 642 nt, Artificial Sequence
  derived and/or modified sequence opt4 from Camrelizumab_LightChain
gacauccagaugacccagagccccagcagccugagcgccagcgugggcgacagagugaccaucaccugccuggccagccagaccaucggcaccuggcugaccugguaccagcagaagcccggcaaggcccccaagcugcugaucuacaccgccaccagccuggccgacggcgugcccagcagauucagcggcagcggcagcggcaccgacuucacccugaccaucagcagccugcagcccgaggacuucgccaccuacuacugccagcagguguacagcauccccuggaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31543 - RNA, 777 nt, Artificial Sequence; identical to SEQ ID NO: 30710
  derived and/or modified sequence opt4 from Caplacizumab_HeavyChain

SEQ ID NO: 31544 - RNA, 657 nt, Artificial Sequence
  derived and/or modified sequence opt4 from Citatuzumab_bogatox_HeavyChain
gaggugcagcuggugcagagcggccccggccuggugcagcccggcggcagcgugagaaucagcugcgccgccagcggcuacaccuucaccaacuacggcaugaacugggugaagcaggcccccggcaagggccuggaguggaugggcuggaucaacaccuacaccggcgagagcaccuacgccgacagcuucaagggcagauucaccuucagccuggacaccagcgccagcgccgccuaccugcagaucaacagccugagagccgaggacaccgccguguacuacugcgccagauucgccaucaagggcgacuacuggggccagggcacccugcugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 31545 - RNA, 1356 nt, Artificial Sequence
  derived and/or modified sequence opt4 from Cosfroviximab_HeavyChain
gacgugaagcugcuggagagcggcggcggccuggugcagcccggcggcagccugaagcugagcugcgccgccagcggcuucagccugagcaccagcggcgugggcgugggcugguucagacagcccagcggcaagggccuggaguggcuggcccugaucuggugggacgacgacaaguacuacaaccccagccugaagagccagcugagcaucagcaaggacuucagcagaaaccagguguuccugaagaucagcaacguggacaucgccgacaccgccaccuacuacugcgccagaagagaccccuucggcuacgacaacgccaugggcuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31546 - RNA, 639 nt, Artificial Sequence
  derived and/or modified sequence opt4 from Cosfroviximab_LightChain
gacaucgugaugacccagagcccccugagccugagcaccagcgugggcgacagagugagccugaccugcaaggccagccagaacgugggcaccgccguggccugguaccagcagaagcccggccagagccccaagcugcugaucuacagcgccagcaacagauacaccggcgugcccgacagauucaccggcagcggcagcggcaccgacuucacccugaccaucagcaacaugcagagcgaggaccuggccgacuacuucugccagcaguacagcagcuacccccugaccuucggcgccggcaccaagcuggagcugagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31547 - RNA, 1344 nt, Artificial Sequence
  derived and/or modified sequence opt4 from Crizanlizumab_HeavyChain
caggugcagcuggugcagagcggcgccgaggugaagaagcccggcgccagcgugaaggugagcugcaaggugagcggcuacaccuucaccagcuacgacaucaacugggugagacaggcccccggcaagggccuggaguggaugggcuggaucuaccccggcgacggcagcaucaaguacaacgagaaguucaagggcagagugaccaugaccguggacaagagcaccgacaccgccuacauggagcugagcagccugagaagcgaggacaccgccguguacuacugcgccagaagaggcgaguacggcaacuacgagggcgccauggacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugaccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcauggaggugcacaacgccaagaccaagcccagagaggagcaguucaacagcaccuucagaguggugagcgugcugaccguggugcaccaggacuggcugaacggcaaggaguacaagugcgccgugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31548 - RNA, 654 nt, Artificial Sequence
  derived and/or modified sequence opt4 from Crizanlizumab_LightChain
gacauccagaugacccagagccccagcagccugagcgccagcgugggcgacagagugaccaucaccugcaaggccagccagagcguggacuacgacggccacagcuacaugaacugguaccagcagaagcccggcaaggcccccaagcugcugaucuacgccgccagcaaccuggagagcggcgugcccagcagauucagcggcagcggcagcggcaccgacuucacccugaccaucagcagccugcagcccgaggacuucgccaccuacuacugccagcagagcgacgagaacccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31549 - RNA, 1365 nt, Artificial Sequence
  derived and/or modified sequence opt4 from Crotedumab_HeavyChain
gaggugcagcugguggagagcggcggcggccuggugcagcccggcggcagccugagacugagcugcgccgccagcggcuucaccuucagcaacuaccugaugaacugggugagacaggcccccggcaagggccuggaguggcuggccaacauccaggaggacggcaucgagaaguacuacguggacagcgugaagggcagauucaccaucagcagagacaacgccaagaacagccuguaccugcagaugaacagccugagagccgaggacaccgccguguacuacugcgccagagagcccagccacuacgacauccugaccggcuacgacuacuacuacggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31550 - RNA, 642 nt, Artificial Sequence
  derived and/or modified sequence opt4 from Crotedumab_LightChain
gacauccagaugacccagagccccagcagccugagcgccagcgugggcgacagagugaccaucaccugcagagccagccagggcaucagaaacgaccugggcugguaccagcagaagcccggcaaggcccccaagagacugaucuacgccgccagcagccugcagagcggcgugcccagcagauucagcggcagcggcagcggcaccgaguucauccugaccgugagcagccugcagcccgaggacuucgccaccuacuacugccugcaguacaacagcaaccccuucaccuucggccccggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31551 - RNA, 1356 nt, Artificial Sequence
  derived and/or modified sequence opt4 from Dezamizumab_HeavyChain
caggugcagcuggugcagagcggcgccgaggugaagaagcccggcagcagcgugaaggugagcugcaaggccagcggcuucaccuucgccaccuacaacaugcacugggugagacaggcccccggccagggccuggaguggaugggcuacaucuaccccggcgacggcaacgccaacuacaaccagcaguucaagggcagagugaccaucaccgccgacaagagcaccagcaccgccuacauggagcugagcagccugagaagcgaggacaccgccguguacuacugcgccagaggcgacuucgacuacgacggcggcuacuacuucgacagcuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31552 - RNA, 642 nt, Artificial Sequence
  derived and/or modified sequence opt4 from Dezamizumab_LightChain
gacauccagaugacccagagccccagcagccugagcgccagcgugggcgacagagugaccaucaccugcagagccagcgagaacaucuacagcuaccuggccugguaccagcagaagcccggcaaggcccccaagcugcugauccacaacgccaagacccuggccgagggcgugcccagcagauucagcggcagcggcagcggcaccgacuucacccugaccaucagcagccugcagcccgaggacuucgccaccuacuacugccagcaccacuacggcgccccccugaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31553 - RNA, 1506 nt, Artificial Sequence
  derived and/or modified sequence opt4 from Duvortuxizumab_Chain1_scFv
gagaacgugcugacccagagccccgccacccugagcgugacccccggcgagaaggccaccaucaccugcagagccagccagagcgugagcuacaugcacugguaccagcagaagcccggccaggcccccagacugcugaucuacgacgccagcaacagagccagcggcgugcccagcagauucagcggcagcggcagcggcaccgaccacacccugaccaucagcagccuggaggccgaggacgccgccaccuacuacugcuuccagggcagcguguaccccuucaccuucggccagggcaccaagcuggagaucaagggcggcggcagcggcggcggcggcgaggugcagcugguggagagcggcggcggccuggugcagcccggcggcagccugagacugagcugcgccgccagcggcuucaccuucagcaccuacgccaugaacugggugagacaggcccccggcaagggccuggagugggugggcagaaucagaagcaaguacaacaacuacgccaccuacuacgccgacagcgugaagggcagauucaccaucagcagagacgacagcaagaacagccuguaccugcagaugaacagccugaagaccgaggacaccgccguguacuacugcgugagacacggcaacuucggcaacagcuacgugagcugguucgccuacuggggccagggcacccuggugaccgugagcagcgccagcaccaagggcgagguggccgccugcgagaaggagguggccgcccuggagaaggagguggccgcccuggagaaggagguggccgcccuggagaagggcggcggcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccuguggugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31554 - RNA, 813 nt, Artificial Sequence
  derived and/or modified sequence opt4 from Duvortuxizumab_Chain2_scFv
caggccguggugacccaggagcccagccugaccgugagccccggcggcaccgugacccugaccugcagaagcagcaccggcgccgugaccaccagcaacuacgccaacugggugcagcagaagcccggccaggcccccagaggccugaucggcggcaccaacaagagagcccccuggacccccgccagauucagcggcagccugcugggcggcaaggccgcccugaccaucaccggcgcccaggccgaggacgaggccgacuacuacugcgcccugugguacagcaaccuguggguguucggcggcggcaccaagcugaccgugcugggcggcggcggcagcggcggcggcggccaggugacccugagagagagcggccccgcccuggugaagcccacccagacccugacccugaccugcaccuucagcggcuucagccugagcaccagcggcaugggcgugggcuggaucagacagccccccggcaaggcccuggaguggcuggcccacaucuggugggacgacgacaagagauacaaccccgcccugaagagcagacugaccaucagcaaggacaccagcaagaaccagguguuccugaccaugaccaacauggaccccguggacaccgccaccuacuacugcgccagaauggagcuguggagcuacuacuucgacuacuggggccagggcaccaccgugaccgugagcagcgccagcaccaagggcaagguggccgccugcaaggagaagguggccgcccugaaggagaagguggccgcccugaaggagaagguggccgcccugaaggag

SEQ ID NO: 31555 - RNA, 681 nt, Artificial Sequence
  derived and/or modified sequence opt4 from Duvortuxizumab_Chain3_h-CH2-CH3
gacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugagcugcgccgugaagggcuucuaccccagcgacaucgccguggagugggagagcaacggccagcccgagaacaacuacaagaccaccccccccgugcuggacagcgacggcagcuucuuccuggugagcaagcugaccguggacaagagcagauggcagcagggcaacguguucagcugcagcgugaugcacgaggcccugcacaacagauacacccagaagagccugagccugagccccggcaag

SEQ ID NO: 31556 - RNA, 360 nt, Artificial Sequence
  derived and/or modified sequence opt4 from Efungumab_HeavyChain
auggccgaggugcagcugguggagagcggcgccgaggugaagaagcccggcgagagccugagaaucagcugcaagggcagcggcugcaucaucagcagcuacuggaucagcugggugagacagaugcccggcaagggccuggaguggaugggcaagaucgaccccggcgacagcuacaucaacuacagccccagcuuccagggccacgugaccaucagcgccgacaagagcaucaacaccgccuaccugcaguggaacagccugaaggccagcgacaccgccauguacuacugcgccagaggcggcagagacuucggcgacagcuucgacuacuggggccagggcacccuggugaccgug

SEQ ID NO: 31557 - RNA, 750 nt, Artificial Sequence
  derived and/or modified sequence opt4 from Efungumab_HeavyChain_LightChain
auggccgaggugcagcugguggagagcggcgccgaggugaagaagcccggcgagagccugagaaucagcugcaagggcagcggcugcaucaucagcagcuacuggaucagcugggugagacagaugcccggcaagggccuggaguggaugggcaagaucgaccccggcgacagcuacaucaacuacagccccagcuuccagggccacgugaccaucagcgccgacaagagcaucaacaccgccuaccugcaguggaacagccugaaggccagcgacaccgccauguacuacugcgccagaggcggcagagacuucggcgacagcuucgacuacuggggccagggcacccuggugaccgugagcagcggcggcggcggcagcggcggcggcggcagcggcggcggcggcagcgacguggugaugacccagagccccagcuuccugagcgccuucgugggcgacagaaucaccaucaccugcagagccagcagcggcaucagcagauaccuggccugguaccagcaggcccccggcaaggcccccaagcugcugaucuacgccgccagcacccugcagaccggcgugcccagcagauucagcggcagcggcagcggcaccgaguucacccugaccaucaacagccugcagcccgaggacuucgccaccuacuacugccagcaccugaacagcuacccccugaccuucggcggcggcaccaagguggacaucaagagagccgccgcccuggag

SEQ ID NO: 31558 - RNA, 339 nt, Artificial Sequence
  derived and/or modified sequence opt4 from Efungumab_LightChain
gacguggugaugacccagagccccagcuuccugagcgccuucgugggcgacagaaucaccaucaccugcagagccagcagcggcaucagcagauaccuggccugguaccagcaggcccccggcaaggcccccaagcugcugaucuacgccgccagcacccugcagaccggcgugcccagcagauucagcggcagcggcagcggcaccgaguucacccugaccaucaacagccugcagcccgaggacuucgccaccuacuacugccagcaccugaacagcuacccccugaccuucggcggcggcaccaagguggacaucaagagagccgccgcccuggag

SEQ ID NO: 31559 - RNA, 1350 nt, Artificial Sequence
  derived and/or modified sequence opt4 from Elezanumab_HeavyChain
gaggugcagcuggugcagagcggcgccgaggugaagaagcccggcgccagcgugaaggugagcugcaaggccagcggcuacaccuucaccagccacggcaucagcugggugagacaggcccccggccagggccuggacuggaugggcuggaucagccccuacagcggcaacaccaacuacgcccagaagcugcagggcagagugaccaugaccaccgacaccagcaccagcaccgccuacauggagcugagcagccugagaagcgaggacaccgccguguacuacugcgccagagugggcagcggccccuacuacuacauggacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaggccgccggcggccccagcguguuccuguucccccccaagcccaaggaccagcugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcugcacgaggcccugcacaaccacuacacccagaagagccugagccugagccccggcaag

SEQ ID NO: 31560 - RNA, 645 nt, Artificial Sequence
  derived and/or modified sequence opt4 from Elezanumab_LightChain
cagagcgcccugacccagcccagaagcgugagcggcagccccggccagagcgugaccaucagcugcaccggcaccagcagcagcgugggcgacagcaucuacgugagcugguaccagcagcaccccggcaaggcccccaagcugaugcuguacgacgugaccaagagacccagcggcgugcccgacagauucagcggcagcaagagcggcaacaccgccagccugaccaucagcggccugcaggccgaggacgaggccgacuacuacugcuacagcuacgccggcaccgacacccuguucggcggcggcaccaaggugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31561 - RNA, 1359 nt, Artificial Sequence
  derived and/or modified sequence opt4 from Emapalumab_HeavyChain
gaggugcagcugcuggagagcggcggcggccuggugcagcccggcggcagccugagacugagcugcgccgccagcggcuucaccuucagcagcuacgccaugagcugggugagacaggcccccggcaagggccuggagugggugagcgccaucagcggcagcggcggcagcaccuacuacgccgacagcgugaagggcagauucaccaucagcagagacaacagcaagaacacccuguaccugcagaugaacagccugagagccgaggacaccgccguguacuacugcgccaaggacggcagcagcggcugguacgugccccacugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31562 - RNA, 651 nt, Artificial Sequence
  derived and/or modified sequence opt4 from Emapalumab_LightChain
aacuucaugcugacccagccccacagcgugagcgagagccccggcaagaccgugaccaucagcugcaccagaagcagcggcagcaucgccagcaacuacgugcagugguaccagcagagacccggcagcagccccaccaccgugaucuacgaggacaaccagagacccagcggcgugcccgacagauucagcggcagcaucgacagcagcagcaacagcgccagccugaccaucagcggccugaagaccgaggacgaggccgacuacuacugccagagcuacgacggcagcaacagauggauguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31563 - RNA, 1341 nt, Artificial Sequence
  derived and/or modified sequence opt4 from Enoblituzumab_HeavyChain
cagguggagcugguggagagcggcggcggccuggugcagcccggcggcagccugagacugagcugcgccgccagcggcuucaccuucaccagcuacuggaugagcugggugagacaggcccccggcaagggccuggagcuggugagcagcaucaccagcuacggcagcuucaccuacuacgccgacagcgugaagggcagauucaccaucagcagagacaacagcaagaacacccuguaccugcagaugaacagccugagagccgaggacaccgccguguacuacugcgccagaaacauguacacccacuucgacagcuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31564 - RNA, 648 nt, Artificial Sequence
  derived and/or modified sequence opt4 from Enoblituzumab_LightChain
gacaucgugcugacccagccccccagcgugagcggcgcccccggccagagagugaccaucagcugcagcggcagcagcagcaacaucggcagcaacagcgugagcugguaccagcagcugcccggcaccgcccccaagcugcugaucuacgacaacagcaagagacccagcggcgugcccgacagauucagcggcagcaagagcggcaccagcgccagccuggccaucaccggccugcagagcgaggacgaggccgacuacuacugccagagcagagacaccuacggcuacuacuggguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaagggcgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31565 - RNA, 1323 nt, Artificial Sequence
  derived and/or modified sequence opt4 from Eptinezumab_HeavyChain
gaggugcagcugguggagagcggcggcggccuggugcagcccggcggcagccugagacugagcugcgccgugagcggcaucgaccugagcggcuacuacaugaacugggugagacaggcccccggcaagggccuggagugggugggcgugaucggcaucaacggcgccaccuacuacgccagcugggccaagggcagauucaccaucagcagagacaacagcaagaccaccguguaccugcagaugaacagccugagagccgaggacaccgccguguacuucugcgccagaggcgacaucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacgccagaguggagcccaagagcugcgacaagacccacaccugcccccccugccccgcccccgagcugcugggcggccccagcgugacccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31566 - RNA, 657 nt, Artificial Sequence
  derived and/or modified sequence opt4 from Eptinezumab_LightChain
caggugcugacccagagccccagcagccugagcgccagcgugggcgacagagugaccaucaacugccaggccagccagagcguguaccacaacaccuaccuggccugguaccagcagaagcccggcaaggugcccaagcagcugaucuacgacgccagcacccuggccagcggcgugcccagcagauucagcggcagcggcagcggcaccgacuucacccugaccaucagcagccugcagcccgaggacguggccaccuacuacugccugggcagcuacgacugcaccaacggcgacugcuucguguucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31567 - RNA, 1368 nt, Artificial Sequence
  derived and/or modified sequence opt4 from Erenumab_HeavyChain
caggugcagcugguggagagcggcggcggcguggugcagcccggcagaagccugagacugagcugcgccgccagcggcuucaccuucagcagcuucggcaugcacugggugagacaggcccccggcaagggccuggaguggguggccgugaucagcuucgacggcagcaucaaguacagcguggacagcgugaagggcagauucaccaucagcagagacaacagcaagaacacccuguuccugcagaugaacagccugagagccgaggacaccgccguguacuacugcgccagagacagacugaacuacuacgacagcagcggcuacuaccacuacaaguacuacggcauggccguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31568 - RNA, 648 nt, Artificial Sequence
  derived and/or modified sequence opt4 from Erenumab_LightChain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgacaacaacaagagacccagcggcauccccgacagauucagcggcagcaagagcggcaccagcaccacccugggcaucaccggccugcagaccggcgacgaggccgacuacuacugcggcaccugggacagcagacugagcgccgugguguucggcggcggcaccaagcugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacggcagccccgugaaggccggcguggagaccaccaagcccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31569 - RNA, 1344 nt, Artificial Sequence
  derived and/or modified sequence opt4 from Fremanezumab_HeavyChain
gaggugcagcugguggagagcggcggcggccuggugcagcccggcggcagccugagacugagcugcgccgccagcggcuucaccuucagcaacuacuggaucagcugggugagacaggcccccggcaagggccuggaguggguggccgagaucagaagcgagagcgacgccagcgccacccacuacgccgaggccgugaagggcagauucaccaucagcagagacaacgccaagaacagccuguaccugcagaugaacagccugagagccgaggacaccgccguguacuacugccuggccuacuucgacuacggccuggccauccagaacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccagcagcaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31570 - RNA, 642 nt, Artificial Sequence
  derived and/or modified sequence opt4 from Fremanezumab_LightChain
gagaucgugcugacccagagccccgccacccugagccugagccccggcgagagagccacccugagcugcaaggccagcaagagagugaccaccuacgugagcugguaccagcagaagcccggccaggcccccagacugcugaucuacggcgccagcaacagauaccugggcauccccgccagauucagcggcagcggcagcggcaccgacuucacccugaccaucagcagccuggagcccgaggacuucgccguguacuacugcagccagagcuacaacuaccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31571 - RNA, 1371 nt, Artificial Sequence
  derived and/or modified sequence opt4 from Frunevetmab_HeavyChain
caggugcagcugguggagagcggcgccgagcuggugcagcccggcgagagccugagacugaccugcgccgccagcggcuucagccugaccaacaacaacgugaacugggugagacaggcccccggcaagggccuggaguggaugggcggcgugugggccggcggcgccaccgacuacaacagcgcccugaagagcagacugaccaucaccagagacaccagcaagaacaccguguuccugcagaugcacagccugcagagcgaggacaccgccaccuacuacugcgccagagacggcggcuacagcagcagcacccuguacgccauggacgccuggggccagggcaccaccgugaccgugagcgccgccagcaccaccgcccccagcguguucccccuggcccccagcugcggcaccaccagcggcgccaccguggcccuggccugccuggugcugggcuacuuccccgagcccgugaccgugagcuggaacagcggcgcccugaccagcggcgugcacaccuuccccgccgugcugcaggccagcggccuguacagccugagcagcauggugaccgugcccagcagcagauggcugagcgacaccuucaccugcaacguggcccacccccccagcaacaccaagguggacaagaccgugagaaagaccgaccacccccccggccccaagcccugcgacugccccaagugccccccccccgagaugcugggcggccccagcaucuucaucuucccccccaagcccaaggacacccugagcaucagcagaacccccgaggugaccugccuggugguggaccugggccccgacgacagcgacgugcagaucaccugguucguggacaacacccagguguacaccgccaagaccagccccagagaggagcaguucaacagcaccuacagaguggugagcgugcugcccauccugcaccaggacuggcugaagggcaaggaguucaagugcaaggugaacagcaagagccugcccagccccaucgagagaaccaucagcaaggccaagggccagccccacgagccccagguguacgugcugccccccgcccaggaggagcugagcagaaacaaggugagcgugaccugccugaucaagagcuuccacccccccgacaucgccguggagugggagaucaccggccagcccgagcccgagaacaacuacagaaccacccccccccagcuggacagcgacggcaccuacuucguguacagcaagcugagcguggacagaagccacuggcagagaggcaacaccuacaccugcagcgugagccacgaggcccugcacagccaccacacccagaagagccugacccagagccccggcaag

SEQ ID NO: 31572 - RNA, 651 nt, Artificial Sequence
  derived and/or modified sequence opt4 from Frunevetmab_LightChain
gacaucgagaugacccagagcccccugagccugagcgugacccccggcgagagcgugagcaucagcugcagagccagcgaggacaucuacaacgcccuggccugguaccugcagaagcccggcagaagccccagacugcugaucuacaacaccgacacccugcacaccggcgugcccgacagauucagcggcagcggcagcggcaccgacuucacccugaagaucagcagagugcagaccgaggacgugggcguguacuucugccagcacuacuuccacuaccccagaaccuucggccagggcaccaagcuggagcugaagagaagcgacgcccagcccagcguguuccuguuccagcccagccuggacgagcugcacaccggcagcgccagcaucgugugcauccugaacgacuucuaccccaaggaggugaacgugaaguggaagguggacggcguggugcagaacaagggcauccaggagagcaccaccgagcagaacagcaaggacagcaccuacagccugagcagcacccugaccaugagcagcaccgaguaccagagccacgagaaguucagcugcgaggugacccacaagagccuggccagcacccuggugaagagcuucaacagaagcgagugccagagagag

SEQ ID NO: 31573 - RNA, 1341 nt, Artificial Sequence
  derived and/or modified sequence opt4 from Gatipotuzumab_HeavyChain
gaggugcagcugguggagagcggcggcggccuggugcagcccggcggcagcaugagacugagcugcguggccagcggcuuccccuucagcaacuacuggaugaacugggugagacaggcccccggcaagggccuggagugggugggcgagaucagacugaagagcaacaacuacaccacccacuacgccgagagcgugaagggcagauucaccaucagcagagacgacagcaagaacagccuguaccugcagaugaacagccugaagaccgaggacaccgccguguacuacugcaccagacacuacuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgagggccugcacaaccacuacacccagaagagccugagccugagccccggcaag

SEQ ID NO: 31574 - RNA, 657 nt, Artificial Sequence
  derived and/or modified sequence opt4 from Gatipotuzumab_LightChain
gacaucgugaugacccagagcccccugagcaaccccgugacccccggcgagcccgccagcaucagcugcagaagcagcaagagccugcugcacagcaacggcaucaccuacuucuucugguaccugcagaagcccggccagagcccccagcugcugaucuaccagaugagcaaccuggccagcggcgugcccgacagauucagcggcagcggcagcggcaccgacuucacccugagaaucagcagaguggaggccgaggacgugggcguguacuacugcgcccagaaccuggagcugccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31575 - RNA, 1365 nt, Artificial Sequence
  derived and/or modified sequence opt4 from Gedivumab_HeavyChain
gaggugcagcugguggagagcggcggcggcguggugcagcccggcaagagccugagacugagcugcgccgccagcggccugaccuucagcagcuacgccgugcacugggugagacaggcccccggcaagggccuggagugggugacccugaucagcuacgacggcgccaaccaguacuacgccgacagcgugaagggcagauucaccaucagcagagacaacagcaagaacaccguguaccugcagaugaacagccugagacccgaggacaccgccguguacuacugcgccgugcccggccccguguucggcaucuucccccccuggagcuacuucgacaacuggggccagggcauccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31576 - RNA, 648 nt, Artificial Sequence
  derived and/or modified sequence opt4 from Gedivumab_LightChain
gagaucgugcugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagagcgaggacuucgccguguacuacugccagcacuacagcaacuggccccccagacugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31577 - RNA, 1329 nt, Artificial Sequence
  derived and/or modified sequence opt4 from Gemetuzumab_HeavyChain
gaggugcagcuggugcagagcggcgccgaggugaagaagcccggcagcagcgugaaggugagcugcaaggccagcggcuacaccaucaccgacagcaacauccacugggugagacaggcccccggccagagccuggaguggaucggcuacaucuaccccuacaacggcggcaccgacuacaaccagaaguucaagaacagagccacccugaccguggacaaccccaccaacaccgccuacauggagcugagcagccugagaagcgaggacaccgccuucuacuacugcgugaacggcaaccccuggcuggccuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31578 - RNA, 654 nt, Artificial Sequence
  derived and/or modified sequence opt4 from Gemetuzumab_LightChain
gacauccagcugacccagagccccagcacccugagcgccagcgugggcgacagagugaccaucaccugcagagccagcgagagccuggacaacuacggcaucagauuccugaccugguuccagcagaagcccggcaaggcccccaagcugcugauguacgccgccagcaaccagggcagcggcgugcccagcagauucagcggcagcggcagcggcaccgaguucacccugaccaucagcagccugcagcccgacgacuucgccaccuacuacugccagcagaccaaggaggugcccuggagcuucggccagggcaccaagguggaggugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31579 - RNA, 1365 nt, Artificial Sequence
  derived and/or modified sequence opt4 from Gilvetmab_HeavyChain
gaggugcagcuggugcagagcggcggcgaccuggugaagcccggcggcagcgugagacugagcugcguggccagcggcuucaacaucaagaacaccuacaugcacugggugagacaggcccccggcaagggccugcaguggaucggcagaaucgcccccgccaacguggacaccaaguacgcccccaaguuccagggcaaggccaccaucagcgccgacaccgccaagaacaccgccuacaugcagcugaacagccugagagccgaggacaccgccguguacuacugcgugcugaucuacuacgacuacgacggcgacaucgacguguggggccagggcacccuggugaccgugagcagcgccagcaccaccgcccccagcguguucccccuggcccccagcugcggcagcaccagcggcagcaccguggcccuggccugccuggugagcggcuacuuccccgagcccgugaccgugagcuggaacagcggcagccugaccagcggcgugcacaccuuccccagcgugcugcagagcagcggccuguacagccugagcagcauggugaccgugcccagcagcagauggcccagcgagaccuucaccugcaacguggcccaccccgccagcaagaccaagguggacaagcccgugcccaagagagagaacggcagagugcccagaccccccgacugccccaagugccccgcccccgagaugcugggcggccccagcguguucaucuucccccccaagcccaaggacacccugcugaucgccagaacccccgaggugaccugcguggugguggcccuggaccccgaggaccccgaggugcagaucagcugguucguggacggcaagcagaugcagaccgccaagacccagcccagagaggagcaguucgccggcaccuacagaguggugagcgugcugcccaucggccaccaggacuggcugaagggcaagcaguucaccugcaaggugaacaacaaggcccugcccagccccaucgagagaaccaucagcaaggccagaggccaggcccaccagcccagcguguacgugcugccccccagcagagaggagcugagcaagaacaccgugagccugaccugccugaucaaggacuucuucccccccgacaucgacguggaguggcagagcaacggccagcaggagcccgagagcaaguacagaaccacccccccccagcuggacgaggacggcagcuacuuccuguacagcaagcugagcguggacaagagcagauggcagagaggcgacaccuucaucugcgccgugaugcacgaggcccugcacaaccacuacacccaggagagccugagccacagccccggcaag

SEQ ID NO: 31580 - RNA, 654 nt, Artificial Sequence
  derived and/or modified sequence opt4 from Gilvetmab_LightChain
gacaucgugaugacccagaccccccugagccugagcgugagccugggcgagcccgccagcaucagcugccacgccagccagaacaucaacguguggcugagcugguacagacagaagcccggccagaucccccagcugcugaucuacaaggccagccaccugcacaccggcgugcccgacagauucagcggcagcggcagcggcaccgacuucacccugagaaucagcagaguggaggccgacgacgccggcguguacuacugccagcagggccagagcuggccccugaccuucggccagggcaccaagguggagaucaagagaaacgacgcccagcccgccguguaccuguuccagcccagccccgaccagcugcacaccggcagcgccagcguggugugccugcugaacagcuucuaccccaaggacaucaacgugaaguggaagguggacggcgugauccaggacaccggcauccaggagagcgugaccgagcaggacagcaaggacagcaccuacagccugagcagcacccugaccaugagcagcaccgaguaccugagccacgagcuguacagcugcgagaucacccacaagagccugcccagcacccugaucaagagcuuccagagaagcgagugccagagaguggac

SEQ ID NO: 31581 - RNA, 1344 nt, Artificial Sequence; identical to SEQ ID NO: 30864
  derived and/or modified sequence opt4 from Ifabotuzumab_HeavyChain

SEQ ID NO: 31582 - RNA, 642 nt, Artificial Sequence; identical to SEQ ID NO: 30865
  derived and/or modified sequence opt4 from Ifabotuzumab_LightChain

SEQ ID NO: 31583 - RNA, 1323 nt, Artificial Sequence
  derived and/or modified sequence opt4 from Iratumumab_HeavyChain
caggugcagcugcagcaguggggcgccggccugcugaagcccagcgagacccugagccugaccugcgccguguacggcggcagcuucagcgccuacuacuggagcuggaucagacagccccccggcaagggccuggaguggaucggcgacaucaaccacggcggcggcaccaacuacaaccccagccugaagagcagagugaccaucagcguggacaccagcaagaaccaguucagccugaagcugaacagcgugaccgccgccgacaccgccguguacuacugcgccagccugaccgccuacuggggccagggcagccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacacccagaagagccugagccugagccccggcaag

SEQ ID NO: 31584 - RNA, 642 nt, Artificial Sequence
  derived and/or modified sequence opt4 from Iratumumab_LightChain
gacauccagaugacccagagccccaccagccugagcgccagcgugggcgacagagugaccaucaccugcagagccagccagggcaucagcagcuggcugaccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacgacagcuaccccaucaccuucggccagggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31585 - RNA, 1344 nt, Artificial Sequence
  derived and/or modified sequence opt4 from Lacnotuzumab_HeavyChain
caggugcagcugcaggagagcggccccggccuggugaagcccagccagacccugagccugaccugcaccgugagcgacuacagcaucaccagcgacuacgccuggaacuggaucagacaguuccccggcaagggccuggaguggaugggcuacaucagcuacagcggcagcaccagcuacaaccccagccugaagagcagaaucaccaucagcagagacaccagcaagaaccaguucagccugcagcugaacagcgugaccgccgccgacaccgccguguacuacugcgccagcuucgacuacgcccacgccauggacuacuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31586 - RNA, 642 nt, Artificial Sequence
  derived and/or modified sequence opt4 from Lacnotuzumab_LightChain
gacaucgugcugacccagagccccgccuuccugagcgugacccccggcgagaaggugaccuucaccugccaggccagccagagcaucggcaccagcauccacugguaccagcagaagaccgaccaggcccccaagcugcugaucaaguacgccagcgagagcaucagcggcauccccagcagauucagcggcagcggcagcggcaccgacuucacccugaccaucagcagcguggaggccgaggacgccgccgacuacuacugccagcagaucaacagcuggcccaccaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31587 - RNA, 1347 nt, Artificial Sequence
  derived and/or modified sequence opt4 from Larcaviximab_HeavyChain
gaggugcagcugcaggagagcggccccgagcuggagaugcccggcgccagcgugaagaucagcugcaaggccagcggcagcagcuucaccggcuucagcaugaacugggugaagcagagcaacggcaagagccuggaguggaucggcaacaucgacaccuacuacggcggcaccaccuacaaccagaaguucaagggcaaggccacccugaccguggacaagagcagcagcaccgccuacaugcagcugaagagccugaccagcgaggacagcgccguguacuacugcgccagaagcgccuacuacggcagcaccuucgccuacuggggccagggcacccuggugaccgugagcgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31588 - RNA, 642 nt, Artificial Sequence
  derived and/or modified sequence opt4 from Larcaviximab_LightChain
gacauccagaugacccagagccccgccagccugagcgccagcgugggcgagaccgugaccaucaccugcagagccagcgagaacaucuacagcuaccuggccugguaccagcagaagcagggcaagagcccccagcugcugguguacaacgccaagacccugaucgagggcgugcccagcagauucagcggcagcggcagcggcacccaguucagccugaagaucaacagccugcagcccgaggacuucggcagcuacuucugccagcaccacuucggcacccccuucaccuucggcagcggcaccgagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31589 - RNA, 1338 nt, Artificial Sequence
  derived and/or modified sequence opt4 from Lendalizumab_HeavyChain
caggugcagcuggugcagagcggcgccgaggugaagaagcccggcgccagcgugaaggugagcugcaaggccagcggcuacaccuucaccgacuacagcauggacugggugagacaggcccccggccagggccuggaguggaugggcgccauccaccugaacaccggcuacaccaacuacaaccagaaguucaagggcagagugaccaugaccagagacaccagcaccagcaccguguacauggagcugagcagccugagaagcgaggacaccgccguguacuacugcgccagaggcuucuacgacggcuacagccccauggacuacuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31590 - RNA, 654 nt, Artificial Sequence
  derived and/or modified sequence opt4 from Lendalizumab_LightChain
gacauccagaugacccagagccccagcagccugagcgccagcgugggcgacagagugaccaucaccugcagagccagcgagagcguggacagcuacggcaacagcuucaugcacugguaccagcagaagcccggcaaggcccccaagcugcugaucuacagagccagcaaccuggagagcggcgugcccagcagauucagcggcagcggcagcggcaccgacuucacccugaccaucagcagccugcagcccgaggacuucgccaccuacuacugccagcagagcaacgaggaccccuacaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31591 - RNA, 1359 nt, Artificial Sequence
  derived and/or modified sequence opt4 from Lesofavumab_HeavyChain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgagagcgagaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31592 - RNA, 657 nt, Artificial Sequence
  derived and/or modified sequence opt4 from Lesofavumab_LightChain
gacaucgugaugacccagagcccccugagccugcccgugacccccggcgagcccgccagcaucagcugcagaagcagccagagccugcugagaagcaacggcuacaacuaccuggacugguaccugcagaagcccggccagagcccccagcugcugaucuaccugggcagcaacagagccagcggcgugcccgacagauucagcggcagcggcagcggcaccgacuucacccugaagaucagcagaguggaggccgaggacgugggcguguacuacugcaugcaggcccugcagacccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31593 - RNA, 1059 nt, Artificial Sequence
  derived and/or modified sequence opt4 from Letolizumab_HeavyChain
gaggugcagcugcuggagagcggcggcggccuggugcagcccggcggcagccugagacugagcugcgccgccagcggcuucaccuucaacugggagcugaugggcugggccagacaggcccccggcaagggccuggagugggugagcggcaucgagggccccggcgacgugaccuacuacgccgacagcgugaagggcagauucaccaucagcagagacaacagcaagaacacccuguaccugcagaugaacagccugagagccgaggacaccgccguguacuacugcgugaaggugggcaaggacgccaagagcgacuacagaggccagggcacccuggugaccgugagcagcgccagcaccgagcccaagagcagcgacaagacccacaccagcccccccagccccgcccccgagcugcugggcggcagcagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31594 - RNA, 1338 nt, Artificial Sequence
  derived and/or modified sequence opt4 from Losatuxizumab_HeavyChain
gaggugcagcugcaggagagcggccccggccuggugaagcccagccagacccugagccugaccugcaccgugagcggcuacagcaucagcagagacuucgccuggaacuggaucagacagccccccggcaagggccuggaguggaugggcuacaucagcuacaacggcaacaccagauaccagcccagccugaagagcagaaucaccaucagcagagacaccagcaagaaccaguucuuccugaagcugaacagcgugaccgccgccgacaccgccaccuacuacugcgugaccgccagcagaggcuuccccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31595 - RNA, 642 nt, Artificial Sequence; identical to SEQ ID NO: 30773
  derived and/or modified sequence opt4 from Losatuxizumab_LightChain

SEQ ID NO: 31596 - RNA, 1338 nt, Artificial Sequence
  derived and/or modified sequence opt4 from Lupartumab_HeavyChain
gaggugcagcugcuggagagcggcggcggccuggugcagcccggcggcagccugagacugagcugcgccgccagcggcuucaccuucagcaacgccuggaugagcugggugagacaggcccccggcaagggccuggagugggugagcuacaucagcagcagcggcagcaccaucuacuacgccgacagcgugaagggcagauucaccaucagcagagacaacagcaagaacacccuguaccugcagaugaacagccugagagccgaggacaccgccguguacuacugcgccagagagggccugugggccuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31597 - RNA, 651 nt, Artificial Sequence
  derived and/or modified sequence opt4 from Lupartumab_LightChain
gagagcgugcugacccagccccccagcgugagcggcgcccccggccagagagugaccaucagcugcaccggcagcagcagcaacaucggcgccggcuacguggugcacugguaccagcagcugcccggcaccgcccccaagcugcugaucuacgacaacaacaagagacccagcggcgugcccgacagauucagcggcagcaagagcggcaccagcgccagccuggccaucagcggccugagaagcgaggacgaggccgacuacuacugcgccgccugggacgacagacugaacggccccguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31598 - RNA, 1731 nt, Artificial Sequence
  derived and/or modified sequence opt4 from Lutikizumab_HeavyChain
gaggugcagcugguggagagcggcggcggcguggugcagcccggcagaagccugagacugagcugcagcgccagcggcuucaucuucagcagauacgacaugagcugggugagacaggcccccggcaagggccuggaguggguggccuacaucagccacggcggcgccggcaccuacuaccccgacagcgugaagggcagauucaccaucagcagagacaacagcaagaacacccuguuccugcagauggacagccugagacccgaggacaccggcguguacuucugcgccagaggcggcgugaccaagggcuacuucgacguguggggccagggcacccccgugaccgugagcagcgccagcaccaagggcccccaggugcagcugguggagagcggcggcggcguggugcagcccggcagaagccugagacugagcugcaccgccagcggcuucaccuucagcauguucggcgugcacugggugagacaggcccccggcaagggccuggaguggguggccgccgugagcuacgacggcagcaacaaguacuacgccgagagcgugaagggcagauucaccaucagcagagacaacagcaagaacauccuguuccugcagauggacagccugagacuggaggacaccgccguguacuacugcgccagaggcagacccaagguggugauccccgccccccuggcccacuggggccagggcacccuggugaccuucagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31599 - RNA, 981 nt, Artificial Sequence
  derived and/or modified sequence opt4 from Lutikizumab_LightChain
gacauccagaugacccagagccccagcagccugagcgccagcgugggcgacagagugaccaucaccugcagagccagcggcaacauccacaacuaccugaccugguaccagcagacccccggcaaggcccccaagcugcugaucuacaacgccaagacccuggccgacggcgugcccagcagauucagcggcagcggcagcggcaccgacuacaccuucaccaucagcagccugcagcccgaggacaucgccaccuacuacugccagcacuucuggagcauccccuacaccuucggccagggcaccaagcugcagaucaccagaaccguggccgcccccgacauccagaugacccagagccccagcagcgugagcgccagcgugggcgacagagugaccaucaccugcagagccagccagggcaucagcagcuggcuggccugguaccagcagaagcccggcaaggcccccaagcugcugaucuacgaggccagcaaccuggagaccggcgugcccagcagauucagcggcagcggcagcggcagcgacuucacccugaccaucagcagccugcagcccgaggacuucgccaccuacuacugccagcagaccagcagcuuccugcugagcuucggcggcggcaccaagguggagcacaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31600 - RNA, 1341 nt, Artificial Sequence
  derived and/or modified sequence opt4 from Oleclumab_HeavyChain
gaggugcagcugcuggagagcggcggcggccuggugcagcccggcggcagccugagacugagcugcgccgccagcggcuucaccuucagcagcuacgccuacagcugggugagacaggcccccggcaagggccuggagugggugagcgccaucagcggcagcggcggcagaaccuacuacgccgacagcgugaagggcagauucaccaucagcagagacaacagcaagaacacccuguaccugcagaugaacagccugagagccgaggacaccgccguguacuacugcgccagacugggcuacggcagaguggacgaguggggcagaggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgaguucgagggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgccagcaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31601 - RNA, 648 nt, Artificial Sequence
  derived and/or modified sequence opt4 from Oleclumab_LightChain
cagagcgugcugacccagccccccagcgccagcggcacccccggccagagagugaccaucagcugcagcggcagccugagcaacaucggcagaaaccccgugaacugguaccagcagcugcccggcaccgcccccaagcugcugaucuaccuggacaaccugagacugagcggcgugcccgacagauucagcggcagcaagagcggcaccagcgccagccuggccaucagcggccugcagagcgaggacgaggccgacuacuacugcgccaccugggacgacagccaccccggcuggaccuucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31602 - RNA, 1449 nt, Artificial Sequence; identical to SEQ ID NO: 31217
  derived and/or modified sequence opt4 from Otlertuzumab_HeavyChain

SEQ ID NO: 31603 - RNA, 339 nt, Artificial Sequence
  derived and/or modified sequence opt4 from Ozoralizumab_HeavyChain
gaggugcagcugguggagagcggcggcggccuggugcagcccggcggcagccugagacugagcugcgccgccagcggcuucaccuucagcgacuacuggauguacugggugagacaggcccccggcaagggccuggagugggugagcgagaucaacaccaacggccugaucaccaaguaccccgacagcgugaagggcagauucaccaucagcagagacaacgccaagaacacccuguaccugcagaugaacagccugagacccgaggacaccgccguguacuacugcgccagaagccccagcggcuucaacagaggccagggcacccuggugaccgug

SEQ ID NO: 31604 - RNA, 1089 nt, Artificial Sequence; identical to SEQ ID NO: 31222
  derived and/or modified sequence opt4 from Ozoralizumab_HeavyChain_HeavyChain_HeavyChain

SEQ ID NO: 31605 - RNA, 1494 nt, Artificial Sequence
  derived and/or modified sequence opt4 from Pasotuxizumab_HeavyChain_LightChain_HeavyChain_LightChain
caggugcagcugguggagagcggcggcggccuggugaagcccggcgagagccugagacugagcugcgccgccagcggcuucaccuucagcgacuacuacauguacugggugagacaggcccccggcaagggccuggaguggguggccaucaucagcgacggcggcuacuacaccuacuacagcgacaucaucaagggcagauucaccaucagcagagacaacgccaagaacagccuguaccugcagaugaacagccugaaggccgaggacaccgccguguacuacugcgccagaggcuucccccugcugagacacggcgccauggacuacuggggccagggcacccuggugaccgugagcagcggcggcggcggcagcggcggcggcggcagcggcggcggcggcagcgacauccagaugacccagagccccagcagccugagcgccagcgugggcgacagagugaccaucaccugcaaggccagccagaacguggacaccaacguggccugguaccagcagaagcccggccaggcccccaagagccugaucuacagcgccagcuacagauacagcgacgugcccagcagauucagcggcagcgccagcggcaccgacuucacccugaccaucagcagcgugcagagcgaggacuucgccaccuacuacugccagcaguacgacagcuaccccuacaccuucggcggcggcaccaagcuggagaucaagagcggcggcggcggcagcgaggugcagcugguggagagcggcggcggccuggugcagcccggcggcagccugaagcugagcugcgccgccagcggcuucaccuucaacaaguacgccaugaacugggugagacaggcccccggcaagggccuggaguggguggccagaaucagaagcaaguacaacaacuacgccaccuacuacgccgacagcgugaaggacagauucaccaucagcagagacgacagcaagaacaccgccuaccugcagaugaacaaccugaagaccgaggacaccgccguguacuacugcgugagacacggcaacuucggcaacagcuacaucagcuacugggccuacuggggccagggcacccuggugaccgugagcagcggcggcggcggcagcggcggcggcggcagcggcggcggcggcagccagaccguggugacccaggagcccagccugaccgugagccccggcggcaccgugacccugaccugcggcagcagcaccggcgccgugaccagcggcaacuaccccaacugggugcagcagaagcccggccaggcccccagaggccugaucggcggcaccaaguuccuggcccccggcacccccgccagauucagcggcagccugcugggcggcaaggccgcccugacccugagcggcgugcagcccgaggacgaggccgaguacuacugcgugcugugguacagcaacagauggguguucggcggcggcaccaagcugaccgugcug

SEQ ID NO: 31606 - RNA, 357 nt, Artificial Sequence
  derived and/or modified sequence opt4 from Pasotuxizumab_HeavyChain1
caggugcagcugguggagagcggcggcggccuggugaagcccggcgagagccugagacugagcugcgccgccagcggcuucaccuucagcgacuacuacauguacugggugagacaggcccccggcaagggccuggaguggguggccaucaucagcgacggcggcuacuacaccuacuacagcgacaucaucaagggcagauucaccaucagcagagacaacgccaagaacagccuguaccugcagaugaacagccugaaggccgaggacaccgccguguacuacugcgccagaggcuucccccugcugagacacggcgccauggacuacuggggccagggcacccuggugaccgug

SEQ ID NO: 31607 - RNA, 369 nt, Artificial Sequence
  derived and/or modified sequence opt4 from Pasotuxizumab_HeavyChain2
gaggugcagcugguggagagcggcggcggccuggugcagcccggcggcagccugaagcugagcugcgccgccagcggcuucaccuucaacaaguacgccaugaacugggugagacaggcccccggcaagggccuggaguggguggccagaaucagaagcaaguacaacaacuacgccaccuacuacgccgacagcgugaaggacagauucaccaucagcagagacgacagcaagaacaccgccuaccugcagaugaacaaccugaagaccgaggacaccgccguguacuacugcgugagacacggcaacuucggcaacagcuacaucagcuacugggccuacuggggccagggcacccuggugaccgug

SEQ ID NO: 31608 - RNA, 321 nt, Artificial Sequence
  derived and/or modified sequence opt4 from Pasotuxizumab_LightChain1
gacauccagaugacccagagccccagcagccugagcgccagcgugggcgacagagugaccaucaccugcaaggccagccagaacguggacaccaacguggccugguaccagcagaagcccggccaggcccccaagagccugaucuacagcgccagcuacagauacagcgacgugcccagcagauucagcggcagcgccagcggcaccgacuucacccugaccaucagcagcgugcagagcgaggacuucgccaccuacuacugccagcaguacgacagcuaccccuacaccuucggcggcggcaccaagcuggagaucaag

SEQ ID NO: 31609 - RNA, 327 nt, Artificial Sequence
  derived and/or modified sequence opt4 from Pasotuxizumab_LightChain2
cagaccguggugacccaggagcccagccugaccgugagccccggcggcaccgugacccugaccugcggcagcagcaccggcgccgugaccagcggcaacuaccccaacugggugcagcagaagcccggccaggcccccagaggccugaucggcggcaccaaguuccuggcccccggcacccccgccagauucagcggcagccugcugggcggcaaggccgcccugacccugagcggcgugcagcccgaggacgaggccgaguacuacugcgugcugugguacagcaacagauggguguucggcggcggcaccaagcugaccgugcug

SEQ ID NO: 31610 - RNA, 1023 nt, Artificial Sequence; identical to SEQ ID NO: 31266
  derived and/or modified sequence opt4 from Placulumab_HeavyChain

SEQ ID NO: 31611 - RNA, 1353 nt, Artificial Sequence
  derived and/or modified sequence opt4 from Porgaviximab_HeavyChain
gaggugcagcugcaggagagcggcggcggccugaugcagcccggcggcagcaugaagcugagcugcguggccagcggcuucaccuucagcaacuacuggaugaacugggugagacagagccccgagaagggccuggaguggguggccgagaucagacugaagagcaacaacuacgccacccacuacgccgagagcgugaagggcagauucaccaucagcagagacgacagcaagagaagcguguaccugcagaugaacacccugagagccgaggacaccggcaucuacuacugcaccagaggcaacggcaacuacagagccauggacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31612 - RNA, 642 nt, Artificial Sequence
  derived and/or modified sequence opt4 from Porgaviximab_LightChain
gacauccagaugacccagagccccgccagccugagcgugagcgugggcgagaccgugagcaucaccugcagagccagcgagaacaucuacagcagccuggccugguaccagcagaagcagggcaagagcccccagcugcugguguacagcgccaccauccuggccgacggcgugcccagcagauucagcggcagcggcagcggcacccaguacagccugaagaucaacagccugcagagcgaggacuucggcaccuacuacugccagcacuucuggggcacccccuacaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31613 - RNA, 1341 nt, Artificial Sequence
  derived and/or modified sequence opt4 from Prezalumab_HeavyChain
gaggugcagcugguggagagcggcggcggccuggugcagcccggcggcagccugagacugagcugcgccgccagcggcuucaccuucagcagcuacuggaugagcugggugagacaggcccccggcaagggccuggaguggguggccuacaucaagcaggacggcaacgagaaguacuacguggacagcgugaagggcagauucaccaucagcagagacaacgccaagaacagccuguaccugcagaugaacagccugagagccgaggacaccgccguguacuacugcgccagagagggcauccugugguucggcgaccugcccaccuucuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31614 - RNA, 642 nt, Artificial Sequence
  derived and/or modified sequence opt4 from Prezalumab_LightChain
gacauccagaugacccagagccccagcagccugagcgccagcgugggcgacagagugaccaucaccugcagagccagccagggcaucagcaacuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacgacagcuaccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31615 - RNA, 342 nt, Artificial Sequence
  derived and/or modified sequence opt4 from Radretumab_HeavyChain
gaggugcagcugcuggagagcggcggcggccuggugcagcccggcggcagccugagacugagcugcgccgccagcggcuucaccuucagcagcuucagcaugagcugggugagacaggcccccggcaagggccuggagugggugagcagcaucagcggcagcagcggcaccaccuacuacgccgacagcgugaagggcagauucaccaucagcagagacaacagcaagaacacccuguaccugcagaugaacagccugagagccgaggacaccgccguguacuacugcgccaagcccuuccccuacuucgacuacuggggccagggcacccuggugaccgug

SEQ ID NO: 31616 - RNA, 1071 nt, Artificial Sequence; identical to SEQ ID NO: 31285
  derived and/or modified sequence opt4 from Radretumab_HeavyChain_LightChain

SEQ ID NO: 31617 - RNA, 693 nt, Artificial Sequence
  derived and/or modified sequence opt4 from Radretumab_LightChain
gccagcgagaucgugcugacccagagccccggcacccugagccugagccccggcgagagagccacccugagcugcagagccagccagagcgugagcagcagcuuccuggccugguaccagcagaagcccggccaggcccccagacugcugaucuacuacgccagcagcagagccaccggcauccccgacagauucagcggcagcggcagcggcaccgacuucacccugaccaucagcagacuggagcccgaggacuucgccguguacuacugccagcagaccggcagaaucccccccaccuucggccagggcaccaagguggagaucaagagcggcggcagcggcggccccagagccgcccccgagguguacgccuucgccacccccgaguggcccggcagcagagacaagagaacccuggccugccugauccagaacuucaugcccgaggacaucagcgugcaguggcugcacaacgaggugcagcugcccgacgccagacacagcaccacccagcccagaaagaccaagggcagcggcuucuucguguucagcagacuggaggugaccagagccgagugggagcagaaggacgaguucaucugcagagccgugcacgaggccgccagccccagccagaccgugcagagagccgugagcgugaaccccgagagcagcagaagaggcggcugc

SEQ ID NO: 31618 - RNA, 1359 nt, Artificial Sequence
  derived and/or modified sequence opt4 from Ranevetmab_HeavyChain1
gaggugcagcugguggagagcggcggcggccuggugcagcccggcggcagccugagacugagcugcguggccagcggcuucagccugaccaacaacaacgugaacugggugagacaggcccccggcaagggccuggagugggugggcggcgugugggccggcggcgccaccgacuacaacagcgcccugaagagcagauucaccaucagcagagacaacgccaagaacaccguguuccugcagaugcacagccugagaagcgaggacaccgccguguacuacugcgccagagacggcggcuacagcagcagcacccuguacgccauggacgccuggggccagggcaccagcgugaccgugagcagcgccagcaccaccgcccccagcguguucccccuggcccccagcugcggcagcaccagcggcagcaccguggcccuggccugccuggugagcggcuacuuccccgagcccgugaccgugagcuggaacagcggcagccugaccagcggcgugcacaccuuccccagcgugcugcagagcagcggccugcacagccugagcagcauggugaccgugcccagcagcagauggcccagcgagaccuucaccugcaacguggugcaccccgccagcaacaccaagguggacaagcccguguucaacgagugcagaugcaccgacaccccccccugccccgugcccgagccccugggcggccccagcgugcugaucuucccccccaagcccaaggacauccugagaaucaccagaacccccgaggugaccugcguggugcuggaccugggcagagaggaccccgaggugcagaucagcugguucguggacggcaaggaggugaucaccgccaagacccagagcagagagcagcaguucaacggcaccuaccagguggugagcgugcugcccaucgagcaccaggacuggcugaccggcaaggaguucaagugcagagugaaccacaucgaccugcccagccccaucgagagaaccaucagcaaggccagaggcagagcccacaagcccagcguguacgugcugccccccagccccaaggagcugagcagcagcgacaccgugagcaucaccugccugaucaaggacuucuacccccccgacaucgacguggaguggcagagcgugggccagcaggagcccgagagaaagcacagaaugacccccccccagcuggacgaggacggcagcuacuuccuguacagcaagcugagcguggacaagagcagauggcagcagggcgaccccuucaccugcgccgugaugcacgagacccugcagaaccacuacaccgaccugagccugagccacagccccggcaag

SEQ ID NO: 31619 - RNA, 1359 nt, Artificial Sequence
  derived and/or modified sequence opt4 from Ranevetmab_HeavyChain2
gaggugcagcugguggagagcggcggcggccuggugcagcccggcggcagccugagacugagcugcguggccagcggcuucagccugaccaacaacaacgugaacugggugagacaggcccccggcaagggccuggagugggugggcggcgugugggccggcggcgccaccgacuacaacagcgcccugaagagcagauucaccaucagcagagacaacgccaagaacaccguguuccugcagaugcacagccugagaagcgaggacaccgccguguacuacugcgccagagacggcggcuacagcagcagcacccuguacgccauggacgccuggggccagggcaccagcgugaccgugagcagcgccagcaccaccgcccccagcguguucccccuggcccccagcugcggcagcaccagcggcagcaccguggcccuggccugccuggugagcggcuacuuccccgagcccgugaccgugagcuggaacagcggcagccugaccagcggcgugcacaccuuccccagcgugcugcagagcagcggccugcacagccugagcagcauggugaccgugcccagcagcagauggcccagcgagaccuucaccugcaacguggugcaccccgccagcaacaccaagguggacaagcccguguucaacgagugcagaugcaccgacaccccccccugccccgugcccgagccccugggcggccccagcgugcugaucuucccccccaagcccaaggacauccugagaaucaccagaacccccgaggugaccugcguggugcuggaccugggcagagaggaccccgaggugcagaucagcugguucguggacggcaaggaggugcugaccgccaagacccagagcagagagcagcaguucaacggcaccuaccagguggugagcgugcugcccaucgagcaccaggacuggcugaccggcaaggaguucaagugcagagugaaccacaucgaccugcccagccccaucgagagaaccaucagcaaggccagaggcagagcccacaagcccagcguguacgugcugccccccagccccaaggagcugagcagcagcgacaccgugagcaucaccugccugaucaaggacuucuacccccccgacaucgacguggaguggcagagcgugggccagcaggagcccgagagaaagcacagaaugacccccccccagcuggacgaggacggcagcuacuuccuguacagcaagcugagcguggacaagagcagauggcagcagggcgaccccuucaccugcgccgugaugcacgagacccugcagaaccacuacaccgaccugagccugagccacagccccggcaag

SEQ ID NO: 31620 - RNA, 651 nt, Artificial Sequence
  derived and/or modified sequence opt4 from Ranevetmab_LightChain
gacaucgugaugacccagagccccgccagccugagccugagccagggcgagaccgugaccaucaccugcagagccagcgaggacaucuacaacgcccuggccugguaccagcagaagcccggccaggcccccaagcugcugaucuacaacaccgacacccugcacaccggcgugcccagcagauucagcggcagcggcagcggcaccgacuucagccugaccaucagcagccuggagcccgaggacguggccguguacuacugccagcacuacuuccacuaccccagaaccuucggccagggcaccaagguggagcugaagagaaacgacgcccagcccgccguguaccuguuccagcccagccccgaccagcugcacaccggcagcgccagcguggugugccugcugaacagcuucuaccccaaggacaucaacgugaaguggaagguggacggcgugauccaggacaccggcauccaggagagcgugaccgagcaggacaaggacagcaccuacagccugagcagcacccugaccaugagcagcaccgaguaccugagccacgagcuguacagcugcgagaucacccacaagagccugcccagcacccugaucaagagcuuccagagaagcgagugccagagaguggac

SEQ ID NO: 31621 - RNA, 1761 nt, Artificial Sequence
  derived and/or modified sequence opt4 from Remtolumab_HeavyChain
gaggugcagcugguggagagcggcggcggccuggugcagcccggcagaagccugagacugagcugcgccgccagcggcuucaccuucgacgacuacgccaugcacugggugagacaggcccccggcaagggccuggagugggugagcgccaucaccuggaacagcggccacaucgacuacgccgacagcguggagggcagauucaccaucagcagagacaacgccaagaacagccuguaccugcagaugaacagccugagagccgaggacaccgccguguacuacugcgccaaggugagcuaccugagcaccgccagcagccuggacuacuggggccagggcacccuggugaccgugagcagcggcggcggcggcagcggcggcggcggcagcgaggugcagcuggugcagagcggcgccgaggugaagaagcccggcagcagcgugaaggugagcugcaaggccagcggcggcagcuucggcggcuacggcaucggcugggugagacaggcccccggccagggccuggaguggaugggcggcaucacccccuucuucggcuucgccgacuacgcccagaaguuccagggcagagugaccaucaccgccgacgagagcaccaccaccgccuacauggagcugagcggccugaccagcgacgacaccgccguguacuacugcgccagagaccccaacgaguucuggaacggcuacuacagcacccacgacuucgacagcuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31622 - RNA, 993 nt, Artificial Sequence
  derived and/or modified sequence opt4 from Remtolumab_LightChain
gacauccagaugacccagagccccagcagccugagcgccagcgugggcgacagagugaccaucaccugcagagccagccagggcaucagaaacuaccuggccugguaccagcagaagcccggcaaggcccccaagcugcugaucuacgccgccagcacccugcagagcggcgugcccagcagauucagcggcagcggcagcggcaccgacuucacccugaccaucagcagccugcagcccgaggacguggccaccuacuacugccagagauacaacagagcccccuacaccuucggccagggcaccaagguggagaucaagagaggcggcagcggcggcggcggcagcggcgagaucgugcugacccagagccccgacuuccagagcgugacccccaaggagaaggugaccaucaccugcagagccagccaggacaucggcagcgagcugcacugguaccagcagaagcccgaccagccccccaagcugcugaucaaguacgccagccacagcaccagcggcgugcccagcagauucagcggcagcggcagcggcaccgacuucacccugaccaucaacggccuggaggccgaggacgccggcaccuacuacugccaccagaccgacagccugcccuacaccuucggccccggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31623 - RNA, 1341 nt, Artificial Sequence
  derived and/or modified sequence opt4 from Rosmantuzumab_HeavyChain
caggugcagcuggugcagagcggcgccgaggugaagaagcccggcgccagcgugaaggugagcugcaaggccagcggcuacaccuucaccgacuacagcauccacugggugagacaggcccccggccagggccuggaguggaucggcuacaucuaccccagcaacggcgacagcggcuacaaccagaaguucaagaacagagugaccaugaccagagacaccagcaccagcaccgccuacauggagcugagcagacugagaagcgaggacaccgccguguacuacugcgccaccuacuucgccaacaacuucgacuacuggggccagggcaccacccugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31624 - RNA, 654 nt, Artificial Sequence
  derived and/or modified sequence opt4 from Rosmantuzumab_LightChain
gacauccagaugacccagagccccagcagccugagcgccagcgugggcgacagagugaccaucaccugcaaggccagccagagcguggacuacgacggcgacagcuacaugaacugguaccagcagaagcccggcaaggcccccaagcugcugaucuacgccgccagcaaccuggagagcggcgugcccagcagauucagcggcagcggcagcggcaccgacuucacccugaccaucagccccgugcaggccgaggacuucgccaccuacuacugccagcagagcaacgaggacccccugaccuucggcgccggcaccaagcuggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31625 - RNA, 1332 nt, Artificial Sequence
  derived and/or modified sequence opt4 from Rozanolixizumab_HeavyChain
gaggugccccugguggagagcggcggcggccuggugcagcccggcggcagccugagacugagcugcgccgugagcggcuucaccuucagcaacuacggcauggugugggugagacaggcccccggcaagggccuggaguggguggccuacaucgacagcgacggcgacaacaccuacuacagagacagcgugaagggcagauucaccaucagcagagacaacgccaagagcagccuguaccugcagaugaacagccugagagccgaggacaccgccguguacuacugcaccaccggcaucgugagacccuuccuguacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31626 - RNA, 657 nt, Artificial Sequence
  derived and/or modified sequence opt4 from Rozanolixizumab_LightChain
gacauccagaugacccagagccccagcagccugagcgccagcgugggcgacagagugaccaucaccugcaagagcagccagagccuggugggcgccagcggcaagaccuaccuguacuggcuguuccagaagcccggcaaggcccccaagagacugaucuaccuggugagcacccuggacagcggcauccccagcagauucagcggcagcggcagcggcaccgaguucacccugaccaucagcagccugcagcccgaggacuucgccaccuacuacugccugcagggcacccacuucccccacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31627 - RNA, 1329 nt, Artificial Sequence
  derived and/or modified sequence opt4 from Sapelizumab_HeavyChain
caggugcagcugcaggagagcggccccggccuggugaagcccagcgagacccugagccugaccugcgccgugagcggccacagcaucagccacgaccacgccuggagcugggugagacagccccccggcgagggccuggaguggaucggcuucaucagcuacagcggcaucaccaacuacaaccccagccugcagggcagagugaccaucagcagagacaacagcaagaacacccuguaccugcagaugaacagccugagagccgaggacaccgccguguacuacugcgccagaagccuggccagaaccaccgccauggacuacuggggcgagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagagcugcguggagugcccccccugccccgccccccccguggccggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcaggagggcaacguguucagcugcagcgugaugcacgaggcccugcacgcccacuacacccagaagagccugagccugagcccc

SEQ ID NO: 31628 - RNA, 642 nt, Artificial Sequence
  derived and/or modified sequence opt4 from Sapelizumab_LightChain
gacauccagaugacccagagccccagcagccugagcgccagcgugggcgacagcgugaccaucaccugccaggccagcaccgacaucagcagccaccugaacugguaccagcagaagcccggcaaggcccccgagcugcugaucuacuacggcagccaccugcugagcggcgugcccagcagauucagcggcagcggcagcggcaccgacuucaccuucaccaucagcagccuggaggccgaggacgccgccaccuacuacugcggccagggcaacagacugcccuacaccuucggccagggcaccaagguggagaucgagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31629 - RNA, 1356 nt, Artificial Sequence
  derived and/or modified sequence opt4 from Selicrelumab_HeavyChain
caggugcagcuggugcagagcggcgccgaggugaagaagcccggcgccagcgugaaggugagcugcaaggccagcggcuacaccuucaccggcuacuacaugcacugggugagacaggcccccggccagggccuggaguggaugggcuggaucaaccccgacagcggcggcaccaacuacgcccagaaguuccagggcagagugaccaugaccagagacaccagcaucagcaccgccuacauggagcugaacagacugagaagcgacgacaccgccguguacuacugcgccagagaccagccccugggcuacugcaccaacggcgugugcagcuacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31630 - RNA, 642 nt, Artificial Sequence
  derived and/or modified sequence opt4 from Selicrelumab_LightChain
gacauccagaugacccagagccccagcagcgugagcgccagcgugggcgacagagugaccaucaccugcagagccagccagggcaucuacagcuggcuggccugguaccagcagaagcccggcaaggcccccaaccugcugaucuacaccgccagcacccugcagagcggcgugcccagcagauucagcggcagcggcagcggcaccgacuucacccugaccaucagcagccugcagcccgaggacuucgccaccuacuacugccagcaggccaacaucuucccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31631 - RNA, 354 nt, Artificial Sequence
  derived and/or modified sequence opt4 from Solitomab_HeavyChain1
gaggugcagcugcuggagcagagcggcgccgagcuggugagacccggcaccagcgugaagaucagcugcaaggccagcggcuacgccuucaccaacuacuggcugggcugggugaagcagagacccggccacggccuggaguggaucggcgacaucuuccccggcagcggcaacauccacuacaacgagaaguucaagggcaaggccacccugaccgccgacaagagcagcagcaccgccuacaugcagcugagcagccugaccuucgaggacagcgccguguacuucugcgccagacugagaaacugggacgagcccauggacuacuggggccagggcaccaccgugaccgug

SEQ ID NO: 31632 - RNA, 375 nt, Artificial Sequence
  derived and/or modified sequence opt4 from Solitomab_HeavyChain2
gacgugcagcuggugcagagcggcgccgaggugaagaagcccggcgccagcgugaaggugagcugcaaggccagcggcuacaccuucaccagauacaccaugcacugggugagacaggcccccggccagggccuggaguggaucggcuacaucaaccccagcagaggcuacaccaacuacgccgacagcgugaagggcagauucaccaucaccaccgacaagagcaccagcaccgccuacauggagcugagcagccugagaagcgaggacaccgccaccuacuacugcgccagauacuacgacgaccacuacugccuggacuacuggggccagggcaccaccgugaccgugagcagcggcgagggcaccagcacc

SEQ ID NO: 31633 - RNA, 1488 nt, Artificial Sequence
  derived and/or modified sequence opt4 from Solitomab_LightChain_HeavyChain_HeavyChain_LightChain
gagcuggugaugacccagagccccagcagccugaccgugaccgccggcgagaaggugaccaugagcugcaagagcagccagagccugcugaacagcggcaaccagaagaacuaccugaccugguaccagcagaagcccggccagccccccaagcugcugaucuacugggccagcaccagagagagcggcgugcccgacagauucaccggcagcggcagcggcaccgacuucacccugaccaucagcagcgugcaggccgaggaccuggccguguacuacugccagaacgacuacagcuacccccugaccuucggcgccggcaccaagcuggagaucaagggcggcggcggcagcggcggcggcggcagcggcggcggcggcagcgaggugcagcugcuggagcagagcggcgccgagcuggugagacccggcaccagcgugaagaucagcugcaaggccagcggcuacgccuucaccaacuacuggcugggcugggugaagcagagacccggccacggccuggaguggaucggcgacaucuuccccggcagcggcaacauccacuacaacgagaaguucaagggcaaggccacccugaccgccgacaagagcagcagcaccgccuacaugcagcugagcagccugaccuucgaggacagcgccguguacuucugcgccagacugagaaacugggacgagcccauggacuacuggggccagggcaccaccgugaccgugagcagcggcggcggcggcagcgacgugcagcuggugcagagcggcgccgaggugaagaagcccggcgccagcgugaaggugagcugcaaggccagcggcuacaccuucaccagauacaccaugcacugggugagacaggcccccggccagggccuggaguggaucggcuacaucaaccccagcagaggcuacaccaacuacgccgacagcgugaagggcagauucaccaucaccaccgacaagagcaccagcaccgccuacauggagcugagcagccugagaagcgaggacaccgccaccuacuacugcgccagauacuacgacgaccacuacugccuggacuacuggggccagggcaccaccgugaccgugagcagcggcgagggcaccagcaccggcagcggcggcagcggcggcagcggcggcgccgacgacaucgugcugacccagagccccgccacccugagccugagccccggcgagagagccacccugagcugcagagccagccagagcgugagcuacaugaacugguaccagcagaagcccggcaaggcccccaagagauggaucuacgacaccagcaagguggccagcggcgugcccgccagauucagcggcagcggcagcggcaccgacuacagccugaccaucaacagccuggaggccgaggacgccgccaccuacuacugccagcaguggagcagcaacccccugaccuucggcggcggcaccaagguggagaucaag

SEQ ID NO: 31634 - RNA, 339 nt, Artificial Sequence
  derived and/or modified sequence opt4 from Solitomab_LightChain1
gagcuggugaugacccagagccccagcagccugaccgugaccgccggcgagaaggugaccaugagcugcaagagcagccagagccugcugaacagcggcaaccagaagaacuaccugaccugguaccagcagaagcccggccagccccccaagcugcugaucuacugggccagcaccagagagagcggcgugcccgacagauucaccggcagcggcagcggcaccgacuucacccugaccaucagcagcgugcaggccgaggaccuggccguguacuacugccagaacgacuacagcuacccccugaccuucggcgccggcaccaagcuggagaucaag

SEQ ID NO: 31635 - RNA, 324 nt, Artificial Sequence
  derived and/or modified sequence opt4 from Solitomab_LightChain2
gccgacgacaucgugcugacccagagccccgccacccugagccugagccccggcgagagagccacccugagcugcagagccagccagagcgugagcuacaugaacugguaccagcagaagcccggcaaggcccccaagagauggaucuacgacaccagcaagguggccagcggcgugcccgccagauucagcggcagcggcagcggcaccgacuacagccugaccaucaacagccuggaggccgaggacgccgccaccuacuacugccagcaguggagcagcaacccccugaccuucggcggcggcaccaagguggagaucaag

SEQ ID NO: 31636 - RNA, 1359 nt, Artificial Sequence
  derived and/or modified sequence opt4 from Suptavumab_HeavyChain2
gaggugcagcugguggagagcggcggcgaccuggugcagcccggcagaagccugagacugagcugcguggccagcggcuucaccuucgacgacuacgccaugcacugggugagacaggcccccggcaagggccuggagugggugagcggcgugagcuggagcggcagcaccgugggcuacgccgacagcgugaagggcagauucaccgugagcagagacaacgcccagaagagccuguaccugcagaugaacagccugagagccgaggacaccgcccuguacuacugcgugaaggacgccuacaaguucaacuacuacuacuacggccuggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31637 - RNA, 1356 nt, Artificial Sequence
  derived and/or modified sequence opt4 from Suvratoxumab_HeavyChain
gaggugcagcugguggagagcggcggcggccuggugcagcccggcggcagccugagacugagcugcgccgccagcggcuucaccuucagcagccacgacaugcacugggugagacaggccaccggcaagggccuggagugggugagcggcaucggcaccgccggcgacaccuacuaccccgacagcgugaagggcagauucaccaucagcagagagaacgccaagaacagccuguaccugcagaugaacagccugagagccggcgacaccgccguguacuacugcgccagagacagauacagccccaccggccacuacuacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccuguacaucaccagagagcccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31638 - RNA, 639 nt, Artificial Sequence
  derived and/or modified sequence opt4 from Suvratoxumab_LightChain
gacauccagaugacccagagccccagcacccugagcgccagcgugggcgacagagugaccaucaccugcagagccagccagagcaucagcagcuggcuggccugguaccagcagaagcccggcaaggcccccaagcugcugaucuacaaggccagcagccuggagagcggcgugcccagcagauucagcggcagcggcagcggcaccgaguucacccugaccaucagcagccugcagcccgacgacuucgccaccuacuacugcaagcaguacgccgacuacuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31639 - RNA, 642 nt, Artificial Sequence
  derived and/or modified sequence opt4 from Tadocizumab_LightChain
gacauccagaugacccagacccccagcacccugagcgccagcgugggcgacagagugaccaucagcugcagagccagccaggacaucaacaacuaccugaacugguaccagcagaagcccggcaaggcccccaagcugcugaucuacuacaccagcacccugcacagcggcgugcccagcagauucagcggcagcggcagcggcaccgacuacacccugaccaucagcagccugcagcccgacgacuucgccaccuacuucugccagcagggcaacacccugcccuggaccuucggccagggcaccaagguggaggugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31640 - RNA, 1341 nt, Artificial Sequence
  derived and/or modified sequence opt4 from Tanezumab_HeavyChain
caggugcagcugcaggagagcggccccggccuggugaagcccagcgagacccugagccugaccugcaccgugagcggcuucagccugaucggcuacgaccugaacuggaucagacagccccccggcaagggccuggaguggaucggcaucaucuggggcgacggcaccaccgacuacaacagcgccgugaagagcagagugaccaucagcaaggacaccagcaagaaccaguucagccugaagcugagcagcgugaccgccgccgacaccgccguguacuacugcgccagaggcggcuacugguacgccaccagcuacuacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccagcagcaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31641 - RNA, 642 nt, Artificial Sequence
  derived and/or modified sequence opt4 from Tanezumab_LightChain
gacauccagaugacccagagccccagcagccugagcgccagcgugggcgacagagugaccaucaccugcagagccagccagagcaucagcaacaaccugaacugguaccagcagaagcccggcaaggcccccaagcugcugaucuacuacaccagcagauuccacagcggcgugcccagcagauucagcggcagcggcagcggcaccgacuucaccuucaccaucagcagccugcagcccgaggacaucgccaccuacuacugccagcaggagcacacccugcccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31642 - RNA, 1353 nt, Artificial Sequence
  derived and/or modified sequence opt4 from Tavolixizumab_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacaacggcaucaccuaccacaaccccagccugaagagcagaaucaccaucaacagagacaccagcaagaaccaguacagccugcagcugaacagcgugacccccgaggacaccgccguguacuacugcgccagauacaaguacgacuacgacggcggccacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagccccaggaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31643 - RNA, 642 nt, Artificial Sequence
  derived and/or modified sequence opt4 from Tavolixizumab_LightChain
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcaagcugcacagcggcgugcccagcagauucagcggcagcggcagcggcaccgacuacacccugaccaucagcagccugcagcccgaggacuucgccaccuacuacugccagcagggcagcgcccugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31644 - RNA, 1335 nt, Artificial Sequence
  derived and/or modified sequence opt4 from Telisotuzumab_HeavyChain
caggugcagcuggugcagagcggcgccgaggugaagaagcccggcgccagcgugaaggugagcugcaaggccagcggcuacaucuucaccgccuacaccaugcacugggugagacaggcccccggccagggccuggaguggaugggcuggaucaagcccaacaacggccuggccaacuacgcccagaaguuccagggcagagugaccaugaccagagacaccagcaucagcaccgccuacauggagcugagcagacugagaagcgacgacaccgccguguacuacugcgccagaagcgagaucaccaccgaguucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacugccacugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31645 - RNA, 654 nt, Artificial Sequence
  derived and/or modified sequence opt4 from Telisotuzumab_LightChain
gacaucgugaugacccagagccccgacagccuggccgugagccugggcgagagagccaccaucaacugcaagagcagcgagagcguggacagcuacgccaacagcuuccugcacugguaccagcagaagcccggccagccccccaagcugcugaucuacagagccagcaccagagagagcggcgugcccgacagauucagcggcagcggcagcggcaccgacuucacccugaccaucagcagccugcaggccgaggacguggccguguacuacugccagcagagcaaggaggacccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31646 - RNA, 1335 nt, Artificial Sequence; identical to SEQ ID NO: 31644
  derived and/or modified sequence opt4 from Telisotuzumab_vedotin_HeavyChain

SEQ ID NO: 31647 - RNA, 654 nt, Artificial Sequence; identical to SEQ ID NO: 31645
  derived and/or modified sequence opt4 from Telisotuzumab_vedotin_LightChain

SEQ ID NO: 31648 - RNA, 1350 nt, Artificial Sequence
  derived and/or modified sequence opt4 from Timigutuzumab_HeavyChain
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaugaacagccugagagccgaggacaccgccguguacuacugcagcagauggggcggcgacggcuucuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgagggccugcacaaccacuacacccagaagagccugagccugagccccggcaag

SEQ ID NO: 31649 - RNA, 642 nt, Artificial Sequence; identical to SEQ ID NO: 31310
  derived and/or modified sequence opt4 from Timigutuzumab_LightChain

SEQ ID NO: 31650 - RNA, 1332 nt, Artificial Sequence; identical to SEQ ID NO: 30694
  derived and/or modified sequence opt4 from Timolumab_HeavyChain

SEQ ID NO: 31651 - RNA, 642 nt, Artificial Sequence; identical to SEQ ID NO: 30695
  derived and/or modified sequence opt4 from Timolumab_LightChain

SEQ ID NO: 31652 - RNA, 1347 nt, Artificial Sequence
  derived and/or modified sequence opt4 from Tomuzotuximab_HeavyChain
caggugcagcugaagcagagcggccccggccuggugcagcccagccagagccugagcaucaccugcaccgugagcggcuucagccugaccaacuacggcgugcacugggugagacagagccccggcaagggccuggaguggcugggcgugaucuggagcggcggcaacaccgacuacaacacccccuucaccagcagacugagcaucaacaaggacaacagcaagagccagguguucuucaagaugaacagccugcagagcaacgacaccgccaucuacuacugcgccagagcccugaccuacuacgacuacgaguucgccuacuggggccagggcacccuggugaccgugagcaccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgagggccugcacaaccacuacacccagaagagccugagccugagccccggcaag

SEQ ID NO: 31653 - RNA, 642 nt, Artificial Sequence; identical to SEQ ID NO: 30725
  derived and/or modified sequence opt4 from Tomuzotuximab_LightChain

SEQ ID NO: 31654 - RNA, 1347 nt, Artificial Sequence; identical to SEQ ID NO: 31453
  derived and/or modified sequence opt4 from Trastuzumab_duocarmazine_HeavyChain

SEQ ID NO: 31655 - RNA, 642 nt, Artificial Sequence; identical to SEQ ID NO: 31310
  derived and/or modified sequence opt4 from Trastuzumab_duocarmazine_LightChain

SEQ ID NO: 31656 - RNA, 1368 nt, Artificial Sequence
  derived and/or modified sequence opt4 from Varisacumab_HeavyChain
caggugcagcuggugcagagcggcgccgaggugaagaagcccggcgccagcgugaaggugagcugcaaggccagcggcggcaccuucagcagcuacgccaucagcugggugagacaggcccccggccagggccuggaguggaugggcggcuucgaccccgaggacggcgagaccaucuacgcccagaaguuccagggcagagugaccaugaccgaggacaccagcaccgacaccgccuacauggagcugagcagccugagaagcgaggacaccgccguguacuacugcgccaccggcagaagcauggugagaggcgugaucauccccuucaacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31657 - RNA, 642 nt, Artificial Sequence
  derived and/or modified sequence opt4 from Varisacumab_LightChain
gacaucagaaugacccagagccccagcagccugagcgccagcgugggcgacagagugaccaucaccugcagagccagccagagcaucagcagcuaccugaacugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcagagcuacagcaccccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31658 - RNA, 1359 nt, Artificial Sequence
  derived and/or modified sequence opt4 from Vunakizumab_HeavyChain
gaggugcagcuggugcagagcggcgccgaggugaagaagcccggcgccagcgugaaggugagcugcaaggccagcggcuacaccuucaccgacuacgaggugcacugggugagacaggcccccggccagggccuggaguggaugggcgugaucgaccccggcaccggcggcguggccuacaaccagaaguucgagggcagagugaccaugaccgccgacaccagcaccagcaccgccuacauggagcugagaagccugagaagcgacgacaccgccguguacuacugcaccagauacagccuguucuacggcagcagccccuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31659 - RNA, 639 nt, Artificial Sequence
  derived and/or modified sequence opt4 from Vunakizumab_LightChain
gagaucgugcugacccagagccccgacuuccagagcgugacccccaaggagaaggugaccaucaccugcagcgccagcagcagcgugaacuacaugcacugguuccagcagaagcccgaccagagccccaagcuguggaucuacagaaccagcaaccuggccagcggcgugcccagcagauucagcggcagcggcagcggcaccgacuacacccugaccaucaacagccuggaggccgaggacgccgccaccuacuacugccagcagagaagcagcuaccccuggaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31660 - RNA, 1341 nt, Artificial Sequence; identical to SEQ ID NO: 31563
  derived and/or modified sequence opt4 from Xentuzumab_HeavyChain

SEQ ID NO: 31661 - RNA, 648 nt, Artificial Sequence; identical to SEQ ID NO: 31564
  derived and/or modified sequence opt4 from Xentuzumab_LightChain

SEQ ID NO: 31662 - RNA, 726 nt, Artificial Sequence
  derived and/or modified sequence opt4 from anti-rabies_SO57_LightChain
augagcgugcccaccauggccugggcccugcugcugcugagccugcugacccagggcaccggcagcugggcccagagcgcccugacccagcccagaagcgugagcggcagccccggccagagcgugaccaucagcugcaccggcaccagcagcgacaucggcggcuacaacuucgugagcugguaccagcagcaccccggcaaggcccccaagcugaugaucuacgacgccaccaagagacccagcggcgugcccgacagauucagcggcagcaagagcggcaacaccgccagccugaccaucagcggccugcaggccgaggacgaggccgacuacuacugcugcagcuacgccggcgacuacacccccggcgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31663 - RNA, 1428 nt, Artificial Sequence
  derived and/or modified sequence opt4 from anti-rabies_SO57_HeavyChain
auggacuggaccuggagauuccuguucgugguggccgccgccaccggcgugcagagccaggugcagcuggugcagagcggcgccgaggugaagaagcccggcagcagcgugaaggugagcugcaaggccagcggcggcaccuucaacagauacaccgugaacugggugagacaggcccccggccagggccuggaguggaugggcggcaucauccccaucuucggcaccgccaacuacgcccagagauuccagggcagacugaccaucaccgccgacgagagcaccagcaccgccuacauggagcugagcagccugagaagcgacgacaccgccguguacuucugcgccagagagaaccuggacaacagcggcaccuacuacuacuucagcggcugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31664 - RNA, 696 nt, Artificial Sequence
  derived and/or modified sequence opt4 from anti-rabies_SOJB_LightChain
auggccuggaccgugcugcugcugggccugcugagccacugcaccggcagcgugaccagcuacgugcugacccagccccccagcgugagcguggcccccggcaagaccgccagaaucaacugcggcggcaacaacaucgaguacagaagcgugcacugguaccagcagaagagcggccaggcccccguggccgugaucuacgacaacagcgacagacccagcggcauccccgagagauucagcggcagcaagagcggcaacaccgccacccugaccaucagcagaguggaggccggcgacgaggccgacuacuacugccaggugugggacaucagcagcgacgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31665 - RNA, 1554 nt, Artificial Sequence
  derived and/or modified sequence opt4 from anti-rabies_SOJB_HeavyChain
auggacacccugugcagcacccugcugcugcugaccauccccagcugggugcugagccagaucacccugaaggagaccggccccacccuggugaagcccacccagacccugacccugaccugcaccuucagcggcuucagccugagcaccagcggcgugggcgugggcuggaucagacagccccccggcaaggcccuggagugggugacccugaucuacugggacgacgacaagagauacagccccagccuggagaacagagugaccaucagaaaggacaccagcaagaaccagguggcccugaccaugaccaacauggacccccuggacaccggcaccuacuacugcgcccacagacagcacaucagcagcuuccccugguucgacagcuggggccagggcacccuggugaccgugagcagcgccagcaccaagggccccagcguguucccccuggcccccugcagcagaagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaccugcaacgugaaccacaagcccagcaacaccaagguggacaagagaguggagcugaagaccccccugggcgacaccacccacaccugccccagaugccccgagcccaagagcugcgacacccccccccccugccccagaugccccgagcccaagagcugcgacacccccccccccugccccagaugccccgagcccaagagcugcgacacccccccccccugccccagaugccccgcccccgagcugcugggcggccccagcguguuccuguucccccccaagcccaaggacacccugaugaucagcagaacccccgaggugaccugcguggugguggacgugagccacgaggaccccgaggugcaguucaagugguacguggacggcguggaggugcacaacgccaagaccaagcccagagaggagcaguucaacagcaccuucagaguggugagcgugcugaccgugcugcaccaggacuggcugaacggcaaggaguacaagugcaaggugagcaacaaggcccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcagcggccagcccgagaacaacuacaacaccaccccccccaugcuggacagcgacggcagcuucuuccuguacagcaagcugaccguggacaagagcagauggcagcagggcaacaucuucagcugcagcgugaugcacgaggcccugcacaacagauucacccagaagagccugagccugagccccggcaag

SEQ ID NO: 31666 - RNA, 702 nt, Artificial Sequence
  derived and/or modified sequence opt4 from anti-rabies_SOJA_LightChain
auggaggcccccgcccagcugcuguuccugcugcugcuguggcugcccgacaccaccggcgagaucgugcugacccagagccccgccacccugagccugagccccggcgagagagccacccuggccugcagagccagccagaccgccagcagauaccuggccugguaccagcagaagcccggccaggcccccagacugcugaucuacgacaccagcaacagagccaccggcauccccgccagauucagcggcagcggcagcggcaccgacuucacccugagcaucagcagccuggagcccgaggacuucgccguguacuacugccagcagagauucaacuggcccuggaccuucggccagggcaccaagguggaguucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31667 - RNA, 1422 nt, Artificial Sequence
  derived and/or modified sequence opt4 from anti-rabies_SOJA_HeavyChain
auggaguucggccugagcuggcuguuccugguggccauccugaagggcgugcagugcgaggugcagcugcuggagagcggcggcggccuggugcagcccggcggcagccugagacugagcugcgccgccagcggcuucaccuucagcaacuacgccaugagcugggugagacaggcccccggcaagggccuggagugggugagcgccaucagcgccagcggccacagcaccuaccuggccgacagcgugaagggcagauucaccaucagcagagacaacagcaagaacacccuguaccugcagaugaacagccugagagccgaggacaccgccguguacuacugcgccaaggacagagaggugaccaugaucguggugcugaacggcggcuucgacuacuggggccagggcaccagagugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31668 - RNA, 321 nt, Artificial Sequence
  derived and/or modified sequence opt4 from anti-rabies_LightChain
gugaugacccagagccccgccacccugagccugagccccggcgagagagccacccugagcugcagagccagccagagcgugagaaacuaccuggccugguaccagcagaagcccggccaggcccccagacugcugaucuacggcgccagcaacagagccaccggcauccccgccagauucagcggcagcggcagcggcaccgacuucacccugaccaucagcagccuggagcccgaggacuucgccguguacuacugccagcagagaagcgacuggccccugagcuucggccagggcaccaagcuggagaucaagagaacc

SEQ ID NO: 31669 - RNA, 333 nt, Artificial Sequence
  derived and/or modified sequence opt4 from anti-rabies_HeavyChain
ggccccgccugggaggugcccgagacccugcccgugcagccccuggacagccccagcguggccauggccugcaccggcgugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggacagcaacagcggcagcuacuacgcccacgaccugggcuacuggggccagggcacccuggugaccgug

SEQ ID NO: 31670 - RNA, 342 nt, Artificial Sequence
  derived and/or modified sequence opt4 from anti-rabies_LightChain
gagcuggugaugacccagagcccccugagccugcccgugacccugggccagcccgccagcaucagcugcagaagcagccagagccugauccacagcaacggcaacaccuaccugaacugguuccagcagagacccggccagagccccagaagacugaucuacaaggugagcgacagagacagcggcgugcccgacagauucagcggcagcggcagcggcaccgacuucacccugaagaucagcagaguggaggccgaggacgugggcguguacuacugccugcagggcacccacuggcccagaaccuucggccagggcaccaagcuggagaucaagagaacc

SEQ ID NO: 31671 - RNA, 351 nt, Artificial Sequence
  derived and/or modified sequence opt4 from anti-rabies_HeavyChain
guggugcagcccggcagaagccugagacugagcugcgccgccagcggcuucaccuucagcagcuacgccaugcacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccagagacaaggcccuggccgccagaagaggcuacuacuacuacuacggcaccgacguguggggccagggcacccuggugaccgugagcagc

SEQ ID NO: 31672 - RNA, 648 nt, Artificial Sequence
  derived and/or modified sequence opt4 from anti-RSV_5ITB_LightChain
agcgacauccagaugacccagagccccagcacccugagcgccagcgugggcgacagagugaccaucaccugcagagccagccagagcaucagcagcuggcuggccugguaccagcagaagcccggcaaggcccccaagcugcugaucuacgacgccagcagccuggagagcggcgugcccagcagauucagcggcagcggcagcggcaccgaguucacccugaccaucagcagccugcagcccgacgacuucgccaccuacuacugccagcaguacaacaccuacagcugguggaccuucggccagggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31673 - RNA, 660 nt, Artificial Sequence
  derived and/or modified sequence opt4 from anti-RSV_5ITB_HeavyChain
guggagagcggcggcggccugauccagcccggcggcagccugagacugagcugcgccgugagcggcuucaccgugagcagcaaguacaugaccugggugagacaggcccccggcaagggccuggagugggugagcgugaucuacggcggcggcagcaccuacuacgccgacagcguggugggcagauucaccaucagcagagacaacagcaagaacacccuguaccugcagaugaacagccugagagccgaggacaccgccguguacuacugcgccagcagacugggcgugagagccaccaccggcgaccuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugc

SEQ ID NO: 31674 - RNA, 639 nt, Artificial Sequence; identical to SEQ ID NO: 31638
  derived and/or modified sequence opt4 from anti-alpha-toxin_4U6V_LightChain

SEQ ID NO: 31675 - RNA, 675 nt, Artificial Sequence
  derived and/or modified sequence opt4 from anti-alpha-toxin_4U6V_HeavyChain
gaggugcagcugguggagagcggcggcggccuggugcagcccggcggcagccugagacugagcugcgccgccagcggcuucaccuucagcagccacgacaugcacugggugagacaggccaccggcaagggccuggagugggugagcggcaucggcaccgccggcgacaccuacuaccccgacagcgugaagggcagauucaccaucagcagagagaacgccaagaacagccuguaccugcagaugaacagccugagagccggcgacaccgccguguacuacugcgccagagacagauacagccccaccggccacuacuacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugc

SEQ ID NO: 31676 - RNA, 879 nt, Artificial Sequence
  derived and/or modified sequence opt4 from anti-alpha-toxin_4U6V_Chain-A
gccgacagcgacaucaacaucaagaccggcaccaccgacaucggcagcaacaccaccgugaagaccggcgaccuggugaccuacgacaaggagaacggcaugcacaagaagguguucuacagcuucaucgacgacaagaaccacaacaagaagcugcuggugaucagaaccaagggcaccaucgccggccaguacagaguguacagcgaggagggcgccaacaagagcggccuggccuggcccagcgccuucaaggugcagcugcagcugcccgacaacgagguggcccagaucagcgacuacuaccccagaaacagcaucgacaccaaggaguacaugagcacccugaccuacggcuucaacggcaacgugaccggcgacgacaccggcaagaucggcggccugaucggcgccaacgugagcaucggccacacccugaaguacgugcagcccgacuucaagaccauccuggagagccccaccgacaagaaggugggcuggaaggugaucuucaacaacauggugaaccagaacuggggccccuacgacagagacagcuggaaccccguguacggcaaccagcuguucaugaagaccagaaacggcagcaugaaggccgccgacaacuuccuggaccccaacaaggccagcagccugcugagcagcggcuucagccccgacuucgccaccgugaucaccauggacagaaaggccagcaagcagcagaccaacaucgacgugaucuacgagagagugagagacgacuaccagcugcacuggaccagcaccaacuggaagggcaccaacaccaaggacaaguggaucgacagaagcagcgagagauacaagaucgacugggagaaggaggagaugaccaac

SEQ ID NO: 31677 - RNA, 879 nt, Artificial Sequence; identical to SEQ ID NO: 31676
  derived and/or modified sequence opt4 from anti-alpha-toxin_4U6V_Chain-B

SEQ ID NO: 31678 - RNA, 642 nt, Artificial Sequence
  derived and/or modified sequence opt4 from anti-IsdB_5D1Q_Chain-A
gacauccagcugacccagagccccagcagcgugagcgccagcgugggcgacagaaucaccaucaccugcagagccagccaggacaucagcaacuggguggccugguaccagcagaagcccggcaaggcccccaagcugcugaucuacagcgccagcagccugcagagcggcgugcccagcagauucagcggcagcggcagcggcaccgacuucacccugaccaucagcagccugcagcccgaggacuucgccaccuacuacugccagcaggccaacaccuuccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31679 - RNA, 783 nt, Artificial Sequence
  derived and/or modified sequence opt4 from anti-IsdB_5D1Q_Chain-B
caggugcagcuggugcagagcggcgccgaggugaagaagcccgccagcagcgugaaggugagcugccaggccagcggcggcagcuucagcaccagaaccaucagcuggcugagacaggcccccggccagggccuggaguggaugggcggcaucagccccaucuucggcgccgccaacuacgcccagagauuccagggcagagugaccaucaccgccgacaagagcaccagcaccgccuacauggagcugaccagccugaccagcgaggacaccgccguguacuacugcgccagagacagaccccccggcgcccaguucgacaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcggcggcggcagcggccaccaccaccaccaccaccaccaccaccacggcggcgacuacaaggaccacgacggcgacuacaaggaccacgacaucgacuacaaggacgacgacgacaag

SEQ ID NO: 31680 - RNA, 822 nt, Artificial Sequence
  derived and/or modified sequence opt4 from anti-IsdB_5D1Q_Chain-C
gaggugcagcugguggagagcggcggcggccuggugcagcccggcggcagccugacccugagcugcgccgccagcggccugaucuucagcgacagcaccaugcacugggugagacaggccagcggcagaggccuggaguggguggccagaaucagaagcaaggccaacaacuacgccaccagcagcgacaagagcgccaccgccuaccuggccagcgugaagggcagauucaccaucagcagagacgacagcaaggacaccaccuuccuggagaugagcagccugaagaucgaggacaccgccguguacuacugcaucgccagcagcaccaccggcugguacgugagagaggacuucgacuacuggggccacggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcggcggcggcagcggccaccaccaccaccaccaccaccaccaccacggcggcgacuacaaggaccacgacggcgacuacaaggaccacgacaucgacuacaaggacgacgacgacaag

SEQ ID NO: 31681 - RNA, 648 nt, Artificial Sequence
  derived and/or modified sequence opt4 from anti-IsdB_5D1Q_Chain-D
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugagcaucagcagacuggagcccgaggacuucgccguguacuacugccugcacuacggcaccagccccauguacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31682 - RNA, 360 nt, Artificial Sequence
  derived and/or modified sequence opt4 from anti-IsdB_5D1Q_Chain-E
cccggcaagaugaccgaccugcaggacaccaaguacgugguguacgagagcguggagaacaacgagagcaugauggacaccuucgugaagcaccccaucaagaccggcaugcugaacggcaagaaguacauggugauggagaccaccaacgacgacuacuggaaggacuucaugguggagggccagagagugagaaccaucagcaaggacgccaagaacaacaccagaaccaucaucuuccccuacguggagggcaagacccuguacgacgccaucgugaaggugcacgugaagaccaucgacuacgacggccaguaccacgugagaaucguggacaaggaggccuucaccaaggccaac

SEQ ID NO: 31683 - RNA, 657 nt, Artificial Sequence
  derived and/or modified sequence opt4 from anti-IsdB_5D1X_Chain-A
gacaucgugaugacccagagcccccugagccugcccgugacccugggccagcccgccagcaucagcugcagcagcgcccagagccuggugcacagcgacggcgacagcuaccugaccugguuccaccagagacccggccagagccccagaagacugaucuacaaggugagcaucagagacgccggcgugcccgacagauucagcggcagcggcagcggcaccgacuucacccugaagaucagcagaguggaggccgaggacgugggcguguacuacugcaugcaggccacccacuggcccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31684 - RNA, 777 nt, Artificial Sequence
  derived and/or modified sequence opt4 from anti-IsdB_5D1X_Chain-B
caggugcagcuggugcagagcggcagcgaggugaagaagcccggcagcagcgugacccugagcugcaaggccagcggcgacaccuucaacacccacaccuacagcugggugagacaggcccccggccagagacuggaguggaucggcggcaucaugcccaucuucgccgccagcaagagcgccccccaccugcaggacagacugaccaucaccgccaacaaggccaccagaaccgccuacauggagcugaccagccugaccagcgacgacagcggcguguacuacugcgccagagacggcagaggcgcccugcaguacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcggcggcggcagcggccaccaccaccaccaccaccaccaccaccacggcggcgacuacaaggaccacgacggcgacuacaaggaccacgacaucgacuacaaggacgacgacgacaag

SEQ ID NO: 31685 - RNA, 822 nt, Artificial Sequence; identical to SEQ ID NO: 31680
  derived and/or modified sequence opt4 from anti-IsdB_5D1X_Chain-C

SEQ ID NO: 31686 - RNA, 648 nt, Artificial Sequence
  derived and/or modified sequence opt4 from anti-IsdB_5D1X_Chain-D
gagaucgugcugacccagacccccgccacccugagccugacccccggcgagagagccacccugaccugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugagcaucagcagacuggagcccgaggacuucgccguguacuacugccugcacuacggcaccagccccauguacuucuucggcagaggcaccgugcuggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31687 - RNA, 354 nt, Artificial Sequence
  derived and/or modified sequence opt4 from anti-IsdB_5D1X_Chain-E
aagaugaccgaccugcaggacaccaaguacgugguguacgagagcguggagaacaacgagagcaugauggacaccuucgugaagcaccccaucaagaccggcaugcugaacggcaagaaguacauggugauggagaccaccaacgacgacuacuggaaggacuucaugguggagggccagagagugagaaccaucagcaaggacgccaagaacaacaccagaaccaucaucuuccccuacguggagggcaagacccuguacgacgccaucgugaaggugcacgugaagaccaucgacuacgacggccaguaccacgugagaaucguggacaaggaggccuucaccaaggccaac

SEQ ID NO: 31688 - RNA, 792 nt, Artificial Sequence
  derived and/or modified sequence opt4 from anti-IsdB_5D1Z_Chain-B
gccgaggugcagcugguggagagcggcggcggcguggugcagcccggcggcagccugagacugagcugcgccgccagcggcuucaccuucaacaaguucuggaugaacugggugagacaggcccccggcaagggccuggaguggguggccgacauccagguggacggcagcgagaagaacuacguggacagcgugaagggcagauucaccaucagcagagacaacggcaagaacagccuguaccugcagaugaacagccugagagccgaggacaccggcguguacuacugcgccagaggcagauacgacuacuggagcggcuaccugagccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcggcggcggcagcggccaccaccaccaccaccaccaccaccaccacggcggcgacuacaaggaccacgacggcgacuacaaggaccacgacaucgacuacaaggacgacgacgacaag

SEQ ID NO: 31689 - RNA, 642 nt, Artificial Sequence
  derived and/or modified sequence opt4 from anti-IsdB_5D1Z_Chain-C
gacauccagcugacccagagccccagcuuccugagcgccagcguggccgacagagugaccaucaccugcagagccagccaggccgugagaagcagccuggccugguaccagcagaagcccggcaaggccccccagcugcugaucuacagcgccagcacccuggagaacggcgugagcagcagauucagcggcagcggccccggcaccgaguucacccugaccaucagcagccugcagcccgaggacgugggcaccuacuacugccagcagcugaacaccuaccccuucaccuucggccccggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31690 - RNA, 810 nt, Artificial Sequence
  derived and/or modified sequence opt4 from anti-IsdB_5D1Z_Chain-D
caggugcagcugcaggagagcggccccggccuggugaagcccagcgagacccugagccugaucugcaccgugagcggcggcagcaucagcagcagcagcuacuacuggggcuggaucagacagacccccgagagaaaccuggaguggaucggcaucaucuacuucagcggcaccaccuacuacaaccccagccugcagagcagagugagcaugagccuggacagaagcaccaacagauucagccugagacugagcagcgugaccgccgccgacaccgccaucuacuacugcgccaagcccaagagcagagacagaggcggccccggcgacgacuacuucggcauggacguguggggccagggcaucauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcggcggcggcagcggccaccaccaccaccaccaccaccaccaccacggcggcgacuacaaggaccacgacggcgacuacaaggaccacgacaucgacuacaaggacgacgacgacaag

SEQ ID NO: 31691 - RNA, 810 nt, Artificial Sequence; identical to SEQ ID NO: 31690
  derived and/or modified sequence opt4 from anti-IsdB_5D1Z_Chain-F

SEQ ID NO: 31692 - RNA, 792 nt, Artificial Sequence; identical to SEQ ID NO: 31688
  derived and/or modified sequence opt4 from anti-IsdB_5D1Z_Chain-G

SEQ ID NO: 31693 - RNA, 642 nt, Artificial Sequence
  derived and/or modified sequence opt4 from anti-IsdB_5D1Z_HeavyChain
gacauccagaugacccagagccccagcuuccugagcgccagcgugggcgacagagugaccaucaccugcagagccagccagggcaucaccaccuaccugggcugguaccagcagagacccggcaaggccccccagcugcugaucuacgccgccagcagccugcagagcggcgugccccccagauucagcggcagcggcagcggcaccgaguucacccugaccaucagcagccugcagcccgaggacuucgccaccuacuacugccagcagcugaacaccuaccccuacaccuucggccccggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31694 - RNA, 471 nt, Artificial Sequence
  derived and/or modified sequence opt4 from anti-IsdB_5D1Z_Chain-I
ggccccgccaaggccaccaacaacaccuaccccauccugaaccaggagcugagagaggccaucaagaaccccgccaucaaggacaaggaccacagcgcccccaacagcagacccaucgacuucgagaugaagaagaaggacggcacccagcaguucuaccacuacgccagcagcgugaagcccgccagagugaucuucaccgacagcaagcccgagaucgagcugggccugcagagcggccaguucuggagaaaguucgagguguacgagggcgacaagaagcugcccaucaagcuggugagcuacgacaccgugaaggacuacgccuacaucagauucagcgugagcaacggcaccaaggccgugaagaucgugagcagcacccacuucaacaacaaggaggagaaguacgacuacacccugauggaguucgcccagcccaucuacaacagcgccgacaaguucaagacc

SEQ ID NO: 31695 - RNA, 324 nt, Artificial Sequence
  derived and/or modified sequence opt4 from anti-HIV_b12_LightChain
gagaucgugcugacccagagccccggcacccugagccugagccccggcgagagagccaccuucagcugcagaagcagccacagcaucagaagcagaagaguggccugguaccagcacaagcccggccaggcccccagacuggugauccacggcgugagcaacagagccagcggcaucagcgacagauucagcggcagcggcagcggcaccgacuucacccugaccaucaccagaguggagcccgaggacuucgcccuguacuacugccagguguacggcgccagcagcuacaccuucggccagggcaccaagcuggagagaaag

SEQ ID NO: 31696 - RNA, 381 nt, Artificial Sequence
  derived and/or modified sequence opt4 from anti-HIV_b12_HeavyChain
caggugcagcuggagcagagcggcgccgaggugaagaagcccggcgccagcgugaaggugagcugccaggccagcggcuacagauucagccacuucaccgugcacugggugagacaggcccccggccagagauucgaguggaugggcuggaucaaccccuacaacggcaacaaggaguucagcgccaaguuccaggacagagugaccuucaccgccgacaccagcgccaacaccgccuacauggagcugagaagccugagaagcgccgacaccgccguguacuacugcgccagagugggcgaguggggcugggacgacagccccuacgacaacuacuacauggacguguggggcaagggcaccaccgugaucgugagcagc

SEQ ID NO: 31697 - RNA, 633 nt, Artificial Sequence
  derived and/or modified sequence opt4 from anti-HIV_2G12_LightChain
guggugaugacccagagccccagcacccugagcgccagcgugggcgacaccaucaccaucaccugcagagccagccagagcaucgagaccuggcuggccugguaccagcagaagcccggcaaggcccccaagcugcugaucuacaaggccagcacccugaagaccggcgugcccagcagauucagcggcagcggcagcggcaccgaguucacccugaccaucagcggccugcaguucgacgacuucgccaccuaccacugccagcacuacgccggcuacagcgccaccuucggccagggcaccagaguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggc

SEQ ID NO: 31698 - RNA, 672 nt, Artificial Sequence
  derived and/or modified sequence opt4 from anti-HIV_2G12_HeavyChain
gaggugcagcugguggagagcggcggcggccuggugaaggccggcggcagccugauccugagcugcggcgugagcaacuucagaaucagcgcccacaccaugaacugggugagaagagugcccggcggcggccuggaguggguggccagcaucagcaccagcagcaccuacagagacuacgccgacgccgugaagggcagauucaccgugagcagagacgaccuggaggacuucguguaccugcagaugcacaagaugagaguggaggacaccgccaucuacuacugcgccagaaagggcagcgacagacugagcgacaacgaccccuucgacgccuggggccccggcaccguggugaccgugagccccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaag

SEQ ID NO: 31699 - RNA, 642 nt, Artificial Sequence
  derived and/or modified sequence opt4 from anti-HIV_4E10_LightChain
gagaucgugcugacccagagccccggcacccagagccugagccccggcgagagagccacccugagcugcagagccagccagagcgugggcaacaacaagcuggccugguaccagcagagacccggccaggcccccagacugcugaucuacggcgccagcagcagacccagcggcguggccgacagauucagcggcagcggcagcggcaccgacuucacccugaccaucagcagacuggagcccgaggacuucgccguguacuacugccagcaguacggccagagccugagcaccuucggccagggcaccaagguggaggugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgag

SEQ ID NO: 31700 - RNA, 684 nt, Artificial Sequence
  derived and/or modified sequence opt4 from anti-HIV_4E10_HeavyChain
caggugcagcuggugcagagcggcgccgaggugaagagacccggcagcagcgugaccgugagcugcaaggccagcggcggcagcuucagcaccuacgcccugagcugggugagacaggcccccggcagaggccuggaguggaugggcggcgugaucccccugcugaccaucaccaacuacgcccccagauuccagggcagaaucaccaucaccgccgacagaagcaccagcaccgccuaccuggagcugaacagccugagacccgaggacaccgccguguacuacugcgccagagagggcaccaccggcuggggcuggcugggcaagcccaucggcgccuucgcccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaag

SEQ ID NO: 31701 - RNA, 312 nt, Artificial Sequence
  derived and/or modified sequence opt4 from anti-HIV_VRC01_LightChain
gagaucgugcugacccagagccccggcacccugagccugagccccggcgagaccgccaucaucagcugcagaaccagccaguacggcagccuggccugguaccagcagagacccggccaggcccccagacuggugaucuacagcggcagcaccagagccgccggcauccccgacagauucagcggcagcagauggggccccgacuacaaccugaccaucagcaaccuggagagcggcgacuucggcguguacuacugccagcaguacgaguucuucggccagggcaccaaggugcagguggacaucaagaga

SEQ ID NO: 31702 - RNA, 363 nt, Artificial Sequence
  derived and/or modified sequence opt4 from anti-HIV_VRC01_HeavyChain
caggugcagcuggugcagagcggcggccagaugaagaagcccggcgagagcaugagaaucagcugcagagccagcggcuacgaguucaucgacugcacccugaacuggaucagacuggcccccggcaagagacccgaguggaugggcuggcugaagcccagaggcggcgccgugaacuacgccagaccccugcagggcagagugaccaugaccagagacguguacagcgacaccgccuuccuggagcugagaagccugaccguggacgacaccgccguguacuucugcaccagaggcaagaacugcgacuacaacugggacuucgagcacuggggcagaggcacccccgugaucgugagcagc

SEQ ID NO: 31703 - RNA, 330 nt, Artificial Sequence
  derived and/or modified sequence opt4 from anti-HIV_PG9_LightChain
cagagcgcccugacccagcccgccagcgugagcggcagccccggccagagcaucaccaucagcugcaacggcaccagcaacgacgugggcggcuacgagagcgugagcugguaccagcagcaccccggcaaggcccccaagguggugaucuacgacgugagcaagagacccagcggcgugagcaacagauucagcggcagcaagagcggcaacaccgccagccugaccaucagcggccugcaggccgaggacgagggcgacuacuacugcaagagccugaccagcaccagaagaagaguguucggcaccggcaccaagcugaccgugcug

SEQ ID NO: 31704 - RNA, 408 nt, Artificial Sequence
  derived and/or modified sequence opt4 from anti-HIV_PG9_HeavyChain
cagagacugguggagagcggcggcggcguggugcagcccggcagcagccugagacugagcugcgccgccagcggcuucgacuucagcagacagggcaugcacugggugagacaggcccccggccagggccuggaguggguggccuucaucaaguacgacggcagcgagaaguaccacgccgacagcguguggggcagacugagcaucagcagagacaacagcaaggacacccuguaccugcagaugaacagccugagaguggaggacaccgccaccuacuucugcgugagagaggccggcggccccgacuacagaaacggcuacaacuacuacgacuucuacgacggcuacuacaacuaccacuacauggacguguggggcaagggcaccaccgugaccgugagcagc

SEQ ID NO: 31705 - RNA, 630 nt, Artificial Sequence
  derived and/or modified sequence opt4 from anti-HIV_VRC07_LightChain
gagaucgugcugacccagagccccggcacccugagccugagccccggcgagaccgccaucaucagcugcagaaccagccaguacggcagccuggccugguaccagcagagacccggccaggcccccagacuggugaucuacagcggcagcaccagagccgccggcauccccgacagauucagcggcagcagauggggccccgacuacacccugaccaucagcaaccuggagagcggcgacuucggcguguacuacugccagcaguacgaguucuucggccagggcaccaaggugcagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagaagccccgugaccaagagcuucaacagaggcgagugc

SEQ ID NO: 31706 - RNA, 375 nt, Artificial Sequence
  derived and/or modified sequence opt4 from anti-HIV_VRC07_HeavyChain
caggugcagcuggugcagagcggcggccagaugaagaagcccggcgagagcaugagaaucagcugcagagccagcggcuacgaguucaucgacugcacccugaacuggaucagacuggcccccggcaagagacccgaguggaugggcuggcugaagcccagaggcggcgccgugaacuacgccagaccccugcagggcagagugaccaugaccagagacguguacagcgacaccgccuuccuggagcugagaagccugaccagcgacgacaccgccguguacuucugcaccagaggcaaguacugcaccgccagagacuacuacaacugggacuucgagcacuggggccagggcacccccgugaucgugagcagc

SEQ ID NO: 31707 - RNA, 315 nt, Artificial Sequence
  derived and/or modified sequence opt4 from anti-HIV_3BNC117_LightChain
gacauccagaugacccagagccccagcagccugagcgccagcgugggcgacaccgugaccaucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcagcccgaggacaucgccaccuacuucugccagguguacgaguucguggugcccggcaccagacuggaccugaagagaaccguggccgccccc

SEQ ID NO: 31708 - RNA, 387 nt, Artificial Sequence
  derived and/or modified sequence opt4 from anti-HIV_3BNC117_HeavyChain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacaguuccagggcagagugagccugaccagacacgccagcugggacuucgacaccuucagcuucuacauggaccugaaggcccugagaagcgacgacaccgccguguacuucugcgccagacagagaagcgacuacugggacuucgacguguggggcagcggcacccaggugaccgugagcagcgccagcaccaagggcccc

SEQ ID NO: 31709 - RNA, 324 nt, Artificial Sequence
  derived and/or modified sequence opt4 from anti-HIV_10-1074_LightChain
agcuacgugagaccccugagcguggcccugggcgagaccgccagaaucagcugcggcagacaggcccugggcagcagagccgugcagugguaccagcacagacccggccaggcccccauccugcugaucuacaacaaccaggacagacccagcggcauccccgagagauucagcggcacccccgacaucaacuucggcaccagagccacccugaccaucagcggcguggaggccggcgacgaggccgacuacuacugccacaugugggacagcagaagcggcuucagcuggagcuucggcggcgccaccagacugaccgugcug

SEQ ID NO: 31710 - RNA, 396 nt, Artificial Sequence
  derived and/or modified sequence opt4 from anti-HIV_10-1074_HeavyChain
caggugcagcugcaggagagcggccccggccuggugaagcccagcgagacccugagcgugaccugcagcgugagcggcgacagcaugaacaacuacuacuggaccuggaucagacagagccccggcaagggccuggaguggaucggcuacaucagcgacagagagagcgccaccuacaaccccagccugaacagcagaguggugaucagcagagacaccagcaagaaccagcugagccugaagcugaacagcgugacccccgccgacaccgccguguacuacugcgccaccgccagaagaggccagagaaucuacggcguggugagcuucggcgaguucuucuacuacuacagcauggacguguggggcaagggcaccaccgugaccgugagcagc

SEQ ID NO: 31711 - RNA, 633 nt, Artificial Sequence
  derived and/or modified sequence opt4 from anti-HIV_PGT121_LightChain
agcgacaucagcguggcccccggcgagaccgccagaaucagcugcggcgagaagagccugggcagcagagccgugcagugguaccagcacagagccggccaggcccccagccugaucaucuacaacaaccaggacagacccagcggcauccccgagagauucagcggcagccccgacagccccuucggcaccaccgccacccugaccaucaccagcguggaggccggcgacgaggccgacuacuacugccacaucugggacagcagagugcccaccaaguggguguucggcggcggcaccacccugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccaccgagugcagc

SEQ ID NO: 31712 - RNA, 705 nt, Artificial Sequence
  derived and/or modified sequence opt4 from anti-HIV_PGT121_HeavyChain
cagaugcagcugcaggagagcggccccggccuggugaagcccagcgagacccugagccugaccugcagcgugagcggcgccagcaucagcgacagcuacuggagcuggaucagaagaagccccggcaagggccuggaguggaucggcuacgugcacaagagcggcgacaccaacuacagccccagccugaagagcagagugaaccugagccuggacaccagcaagaaccaggugagccugagccugguggccgccaccgccgccgacagcggcaaguacuacugcgccagaacccugcacggcagaagaaucuacggcaucguggccuucaacgagugguucaccuacuucuacauggacguguggggcaacggcacccaggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugc

SEQ ID NO: 31713 - RNA, 657 nt, Artificial Sequence
  derived and/or modified sequence opt4 from anti-HIV_PGDM1400_LightChain
gacuucgugcugacccagagcccccacagccugagcgugacccccggcgagagcgccagcaucagcugcaagagcagccacagccugauccacggcgacagaaacaacuaccuggccugguacgugcagaagcccggcagaagcccccagcugcugaucuaccuggccagcagcagagccagcggcgugcccgacagauucagcggcagcggcagcgacaaggacuucacccugaagaucagcagaguggagaccgaggacgugggcaccuacuacugcaugcagggcagagagagccccuggaccuucggccagggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31714 - RNA, 735 nt, Artificial Sequence
  derived and/or modified sequence opt4 from anti-HIV_PGDM1400_HeavyChain
caggcccagcuggugcagagcggccccgaggugagaaagcccggcaccagcgugaaggugagcugcaaggcccccggcaacacccugaagaccuacgaccugcacugggugagaagcgugcccggccagggccugcaguggaugggcuggaucagccacgagggcgacaagaaggugaucguggagagauucaaggccaaggugaccaucgacugggacagaagcaccaacaccgccuaccugcagcugagcggccugaccagcggcgacaccgccguguacuacugcgccaagggcagcaagcacagacugagagacuacgcccuguacgacgacgacggcgcccugaacugggccguggacguggacuaccugagcaaccuggaguucuggggccagggcaccgccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgac

SEQ ID NO: 31715 - RNA, 630 nt, Artificial Sequence
  derived and/or modified sequence opt4 from anti-HIV_N6_LightChain
uacauccacgugacccagagccccagcagccugagcgugagcaucggcgacagagugaccaucaacugccagaccagccagggcgugggcagcgaccugcacugguaccagcacaagcccggcagagcccccaagcugcugauccaccacaccagcagcguggaggacggcgugcccagcagauucagcggcagcggcuuccacaccagcuucaaccugaccaucagcgaccugcaggccgacgacaucgccaccuacuacugccaggugcugcaguucuucggcagaggcagcagacugcacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31716 - RNA, 675 nt, Artificial Sequence
  derived and/or modified sequence opt4 from anti-HIV_N6_HeavyChain
agagcccaccuggugcagagcggcaccgccaugaagaagcccggcgccagcgugagagugagcugccagaccagcggcuacaccuucaccgcccacauccuguucugguucagacaggcccccggcagaggccuggagugggugggcuggaucaagccccaguacggcgccgugaacuucggcggcggcuucagagacagagugacccugaccagagacguguacagagagaucgccuacauggacaucagaggccugaagcccgacgacaccgccguguacuacugcgccagagacagaagcuacggcgacagcagcugggcccuggacgccuggggccagggcaccaccgugguggugagcgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 31717 - RNA, 1080 nt, Artificial Sequence
  derived and/or modified sequence opt4 from anti-HIV_N6_GChain
gccugggaggacgccgacaccacccuguucugcgccagcgacgccaaggccuacagcaccgagaagcacaacgugugggccacccacgccugcgugcccaccgaccccgacccccaggagaucccccuggagaacgugaccgagaacuucaacauguggaagaacaacaugguggagcagaugcacgaggacaucaucagccugugggacgagagccugaagcccugcgugaugcugaccggcggcagcaccaucaagcaggccugccccaaggugaccuucgagcccauccccauccacuacugcgcccccgccggcuucgccauccugaagugcagagacgaggacuucaacggcaccggccccugcaagaacgugagcaccgugcagugcacccacggcaucaagcccguggugagcacccagcugcugcugaacggcagccuggccaagggcgacaucgugaucagaagcgagaaccugaccaacaacgccaaggugaucaucgugcagcugaacgagcccgugcagaucgugugcaucagacccaacaacggcggcagcggcagcggcggcgacaucagacaggcccacugcaacgugaccagaggcaagugggugaacaucaccaagaacgugaaggagcagcuguggaagaucuucaacaagaccaccaacaucaccuucaacaacaccaucuucaacagccccgccggcggcgaccuggagaucaccacccacagcuucaacugcggcggcgaguucuucuacugcaacaccagcgaccuguucaacgagaccaaccugagcgccaaccacaccgacaccaacgagaacaucacccugcagugcagaaucaagcagaucgugagaauguggcagagagugggccaggccauguacgccccccccaucgccggcaacaucaccugcaucagcaacaucaccggccugcugcugaccagagacggcgugaacgacacccacgacaaggagaacgagaccuucagacccaccggcggcgacaugagagacaacuggagaagcgagcuguacaaguacaaggugaucaagcugaag

SEQ ID NO: 31718 - RNA, 645 nt, Artificial Sequence
  derived and/or modified sequence opt4 from anti-HIV_10E8_LightChain
agcuacgagcugacccaggagaccggcgugagcguggcccugggcagaaccgugaccaucaccugcagaggcgacagccugagaagccacuacgccagcugguaccagaagaagcccggccaggcccccauccugcuguucuacggcaagaacaacagacccagcggcgugcccgacagauucagcggcagcgccagcggcaacagagccagccugaccaucagcggcgcccaggccgaggacgacgccgaguacuacugcagcagcagagacaagagcggcagcagacugagcguguucggcggcggcaccaagcugaccgugcugagccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31719 - RNA, 708 nt, Artificial Sequence
  derived and/or modified sequence opt4 from anti-HIV_10E8_HeavyChain
gaggugcagcugguggagagcggcggcggccuggugaagcccggcggcagccugagacugagcugcagcgccagcggcuucgacuucgacaacgccuggaugaccugggugagacagccccccggcaagggccuggagugggugggcagaaucaccggccccggcgagggcuggagcguggacuacgccgcccccguggagggcagauucaccaucagcagacugaacagcaucaacuuccuguaccuggagaugaacaaccugagaauggaggacagcggccuguacuucugcgccagaaccggcaaguacuacgacuucuggagcggcuacccccccggcgaggaguacuuccaggacuggggcagaggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaag

SEQ ID NO: 31720 - RNA, 333 nt, Artificial Sequence
  derived and/or modified sequence opt4 from anti-HIV_12A12_LightChain
gacauccagaugacccagagccccagcagccugagcgccagcgugggcgacagagugaccaucaccugccaggccggccagggcaucggcagcagccugcagugguaccagcagaagcccggcaaggcccccaagcugcuggugcacggcgccagcaaccugcacagaggcgugcccagcagauucagcggcagcggcuuccacaccaccuucagccugaccaucagcggccugcagagagacgacuucgccaccuacuucugcgccgugcuggaguucuucggccccggcaccaagguggagaucaagagaaccguggccgcccccagcgug

SEQ ID NO: 31721 - RNA, 381 nt, Artificial Sequence
  derived and/or modified sequence opt4 from anti-HIV_12A12_HeavyChain
agccagcaccuggugcagagcggcacccaggugaagaagcccggcgccagcgugagaaucagcugccaggccagcggcuacagcuucaccgacuacgugcugcacugguggagacaggcccccggccagggccuggaguggaugggcuggaucaagcccguguacggcgccagaaacuacgccagaagauuccagggcagaaucaacuucgacagagacaucuacagagagaucgccuucauggaccugagcggccugagaagcgacgacaccgcccuguacuucugcgccagagacggcagcggcgacgacaccagcuggcaccuggaccccuggggccagggcacccuggugaucgugagcgccgccagcaccaagggc

SEQ ID NO: 31722 - RNA, 315 nt, Artificial Sequence
  derived and/or modified sequence opt4 from anti-HIV_12A21_LightChain
gacauccagaugacccagagccccagcagccugagcgccagcgugggcgacagagugaccaucaacugccaggccggccagggcaucggcagcagccugaacugguaccagaagaagcccggcagagcccccaagcugcuggugcacggcgccagcaaccugcagagaggcgugcccagcagauucagcggcagcggcuuccacaccaccuucacccugaccaucagcagccugcagcccgacgacguggccaccuacuucugcgccguguuccagugguucggccccggcaccaagguggacaucaagagaacc

SEQ ID NO: 31723 - RNA, 384 nt, Artificial Sequence
  derived and/or modified sequence opt4 from anti-HIV_12A21_HeavyChain
agccagcaccuggugcagagcggcacccaggugaagaagcccggcgccagcgugagagugagcugccaggccagcggcuacaccuucaccaacuacauccugcacugguggagacaggcccccggccagggccuggaguggaugggccugaucaagcccguguucggcgccgugaacuacgccagacaguuccagggcagaauccagcugaccagagacaucuacagagagaucgccuuccuggaccugagcggccugagaagcgacgacaccgccguguacuacugcgccagagacgagagcggcgacgaccugaaguggcaccugcaccccuggggccagggcacccaggugaucgugagccccgccagcaccaagggcccc

SEQ ID NO: 31724 - RNA, 648 nt, Artificial Sequence
  derived and/or modified sequence opt4 from anti-HIV_35022_LightChain
cagagcgugcugacccagagcgccagcgugagcggcagccugggccagagcgugaccaucagcugcaccggccccaacagcgugugcugcagccacaagagcaucagcugguaccaguggccccccggcagagcccccacccugaucaucuacgaggacaacgagagagcccccggcaucagccccagauucagcggcuacaagagcuacuggagcgccuaccugaccaucagcgaccugagacccgaggacgagaccaccuacuacugcugcagcuacacccacaacagcggcugcguguucggcaccggcaccaaggugagcgugcugggccagagcaaggccaaccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31725 - RNA, 729 nt, Artificial Sequence
  derived and/or modified sequence opt4 from anti-HIV_35022_HeavyChain
gagggccagcuggugcagagcggcgccgagcugaagaagcccggcgccagcgugaagaucagcugcaagaccagcggcuacagauucaacuucuaccacaucaacuggaucagacagaccgccggcagaggccccgaguggaugggcuggaucagccccuacagcggcgacaagaaccuggcccccgccuuccaggacagagugaucaugaccaccgacaccgaggugcccgugaccagcuucaccagcaccggcgccgccuacauggagaucagaaaccugaaguucgacgacaccggcaccuacuucugcgccaagggccugcugagagacggcagcagcaccuggcugcccuaccuguggggccagggcacccugcugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagggccuggaggugcuguuccag

SEQ ID NO: 31726 - RNA, 648 nt, Artificial Sequence
  derived and/or modified sequence opt4 from anti-HIV_3BC176_LightChain
cagagcgugcugacccagcccgccagcgugagcgccagccccggccagagcaucaccgugagcugcaccggcagcagaaacgacgugggcggcuacgacuucgugagcugguaccagagacaccccggcggcgugcccaagcugaucaucuacgagaucagcaagagacccagcggcaucccccagagauucagcggcagcagaagcggcaacaccgccagccugaccaucagcggccugcaggacgacgacgaggccgacuacuacugcugcagcuacgccagcuacgacagacugaucuucggcggcggcaccagagugagcgugcugagacagcccaaggccgcccccagcgugacccuguucccccccagcagcgaggagcugcaggccaacaaggccacccuggugugccugaucagcgacuucuaccccggcgccgugaccguggccuggaaggccgacggcagccccgugaaggccggcguggagaccaccaagcccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31727 - RNA, 699 nt, Artificial Sequence
  derived and/or modified sequence opt4 from anti-HIV_3BC176_HeavyChain
gagcaggugcagcugaugcagagcggcgcccagcugagagaccccggcgacagccugaagaucagcugcaaggccagcggcuacaacuucaucgacuaccacauccacugggugagacuggcccccggcagaggccuggaguggaugggcuggaucgaccccgugggcggcaucaccaaguacgccggccaguuccagggcagacugagccugaccagagacaccagcaccaacacccuguuccuggagcugagcagacugaccgccggcgacaccgccguguacuucugcgccagaagcaugagacccguggaccacggcaucgacuacagcggccuguucguguuccacuucuggggcagaggcagcgacgugcuggugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgac

SEQ ID NO: 31728 - RNA, 621 nt, Artificial Sequence
  derived and/or modified sequence opt4 from anti-HIV_3BNC55_LightChain
gacauccagaugacccagagccccagcagccugagcgccagcgugggcgacaaggugaccaucaccugccagaccagcgccggcuaccugaacugguaccagcagagaagaggcagagcccccaagcugcugauguacgacggcagcagacuggugaccggcgugcccagcagauucagcggcagaagauggggcacccaguacaaccugaccaucggcagccugcagcccgaggacaucgccaccuacuacugccagguguacgaguucuucggccccggcaccagacuggaccugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31729 - RNA, 675 nt, Artificial Sequence
  derived and/or modified sequence opt4 from anti-HIV_3BNC55_HeavyChain
caggugcagcuggugcagagcggcaccgccgugaagagacccggcgccagcgugagagugagcugccaggccagcggcuacaccuucaccgacuacuucaucuacugguggagacaggcccccggccagggccuggaguggcugggcuggaucaacccccugaccagccagcccagcuaccccagcagauuccagggcagacugacccugaccagagacaccuucgacgagaugcuguacauggaccugagaggccugagaagcgacgacaccggcaucuacuucugcgccagaagacacagcgacuacugcgacuucgacaucuggggcagcggcacccagaucaucgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacc

SEQ ID NO: 31730 - RNA, 618 nt, Artificial Sequence
  derived and/or modified sequence opt4 from anti-HIV_3BNC60_LightChain
gacauccagaugacccagagccccagcagccugagcgccagagugggcgacaccgugaccaucaccugccaggccaacggcuaccugaacugguaccagcagagaagaggcaaggcccccaagcugcugaucuacgacggcagcaagcuggagagaggcgugcccgccagauucagcggcagaagauggggccaggaguacaaccugaccaucaacaaccugcagcccgaggacguggccaccuacuucugccagguguacgaguucaucgugcccggcaccagacuggaccugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31731 - RNA, 687 nt, Artificial Sequence
  derived and/or modified sequence opt4 from anti-HIV_3BNC60_HeavyChain
caggugcaccugagccagagcggcgccgccgugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagagugagccugaccagacaggccagcugggacuucgacaccuacagcuucuacauggaccugaaggccgugagaagcgacgacaccgccaucuacuucugcgccagacagagaagcgacuucugggacuucgacguguggggcagcggcacccaggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacc

SEQ ID NO: 31732 - RNA, 687 nt, Artificial Sequence
  derived and/or modified sequence opt4 from anti-HIV_3BNC60_HeavyChain
gaggugcaccugagccagagcggcgccgccgugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaacgccagacaguuccagggcagagugagccugaccagacaggccagcugggacuucgacaccuacagcuucuacauggaccugaaggccgugagaagcgacgacaccgccaucuacuucugcgccagacagagaagcgacuucugggacuucgacguguggggcagcggcacccaggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacc

SEQ ID NO: 31733 - RNA, 648 nt, Artificial Sequence
  derived and/or modified sequence opt4 from anti-HIV_447-52D_LightChain
cagagcgugcugacccagccccccagcgugagcgccgcccccggccagaaggugaccaucagcugcagcggcagcagcagcaacaucggcaacaacuacgugcugugguaccagcaguuccccggcaccgcccccaagcugcugaucuacggcaacaacaagagacccagcggcauccccgacagauucagcggcagcaagagcggcaccagcgccacccugggcaucaccggccugcagaccggcgacgaggccgacuacuucugcgccaccugggacagcggccugagcgccgacuggguguucggcggcggcaccaagcugaccgugcugagccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugc

SEQ ID NO: 31734 - RNA, 693 nt, Artificial Sequence
  derived and/or modified sequence opt4 from anti-HIV_447-52D_HeavyChain
gaggugcagcugguggagagcggcggcggccuggugaagcccggcggcagccugagacugaccugcguggccagcggcuucaccuucagcgacguguggcugaacugggugagacaggcccccggcaagggccuggagugggugggcagaaucaagagcagaaccgacggcggcaccaccgacuacgccgccagcgugaagggcagauucaccaucagcagagacgacagcaagaacacccuguaccugcagaugaacagccugaagaccgaggacaccgccguguacagcugcaccaccgacggcuucaucaugaucagaggcgugagcgaggacuacuacuacuacuacauggacguguggggcaagggcaccaccgugaccgugagcagcgccagcaccaagggccccagcguguucccccuggcccccugcagcagaagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaccugcaacgugaaccacaagcccagcaacaccaagguggacaagagaguggagcug

SEQ ID NO: 31735 - RNA, 645 nt, Artificial Sequence
  derived and/or modified sequence opt4 from anti-HIV_447-52D_LightChain
cagagcgugcugacccagccccccagcgugagcgccgcccccggccagaaggugaccaucagcugcagcggcagcagcagcaacaucggcaacaacuacgugcugugguaccagcaguuccccggcaccgcccccaagcugcugaucuacggcaacaacaagagacccagcggcauccccgacagauucagcggcagcaagagcggcaccagcgccacccugggcaucaccggccugcagaccggcgacgaggccgacuacuucugcgccaccugggacagcggccugagcgccgacuggguguucggcggcggcaccaagcugaccgugcugagccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgag

SEQ ID NO: 31736 - RNA, 705 nt, Artificial Sequence
  derived and/or modified sequence opt4 from anti-HIV_447-52D_HeavyChain
gaggugcagcugguggagagcggcggcggccuggugaagcccggcggcagccugagacugaccugcguggccagcggcuucaccuucagcgacguguggcugaacugggugagacaggcccccggcaagggccuggagugggugggcagaaucaagagcagaaccgacggcggcaccaccgacuacgccgccagcgugaagggcagauucaccaucagcagagacgacagcaagaacacccuguaccugcagaugaacagccugaagaccgaggacaccgccguguacagcugcaccaccgacggcuucaucaugaucagaggcgugagcgaggacuacuacuacuacuacauggacguguggggcaagggcaccaccgugaccgugagcagcgccagcaccaagggccccagcguguucccccuggcccccugcagcagaagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaccugcaacgugaaccacaagcccagcaacaccaagguggacaagagaguggagcugaagacccccacc

SEQ ID NO: 31737 - RNA, 624 nt, Artificial Sequence
  derived and/or modified sequence opt4 from anti-HIV_5H/I1-BMV-D5_LightChain
gacauccagaugacccagagccccagcacccugagcgccagcaucggcgacagagugaccaucaccugcagagccagcgagggcaucuaccacuggcuggccugguaccagcagaagcccggcaaggcccccaagcugcugaucuacaaggccagcagccuggccagcggcgcccccagcagauucagcggcagcggcagcggcaccgacuucacccugaccaucagcagccugcagcccgacgacuucgccaccuacuacugccagcaguacagcaacuacccccugaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagc

SEQ ID NO: 31738 - RNA, 651 nt, Artificial Sequence
  derived and/or modified sequence opt4 from anti-HIV_5H/I1-BMV-D5_HeavyChain
caggugcagcuggugcagagcggcgccgaggugagaaagcccggcgccagcgugaaggugagcugcaaggccagcggcgacaccuucagcagcuacgccaucagcugggugagacaggcccccggccagggccuggaguggaugggcggcaucauccccaucuucggcaccgccaacuacgcccaggccuuccagggcagagugaccaucaccgccaacgagagcaccagcaccgccuacauggagcugagcagccugagaagcgaggacaccgccaucuacuacugcgccagagacaaccccacccugcugggcagcgacuacuggggcgccggcacccuggugaccgugagcagcgccagcaccaagggccccagcguguucccccuggcccccugcagcagaagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagagug

SEQ ID NO: 31739 - RNA, 657 nt, Artificial Sequence
  derived and/or modified sequence opt4 from anti-HIV_5H/I1-BMV-D5_A-Chain
augcagcugcugagcggcaucgugcagcagcagaacaaccugcugagagccaucgaggcccagcagcaccugcugcagcugaccguguggggcaucaagcagcugcaggccagaauccuggccggcggcagcggcggccacaccaccuggauggagugggacagagagaucaacaacuacaccagccugauccacagccugaucgaggagagccagaaccagcaggagaagaacgagcaggagcugcuggagggcagcagcggcggccagcugcugagcggcaucgugcagcagcagaacaaccugcugagagccaucgaggcccagcagcaccugcugcagcugaccguguggggcaucaagcagcugcaggccagaauccuggccggcggcagcggcggccacaccaccuggauggagugggacagagagaucaacaacuacaccagccugauccacagccugaucgaggagagccagaaccagcaggagaagaacgagcaggagcugcuggagggcagcagcggcggccagcugcugagcggcaucgugcagcagcagaacaaccugcugagagccaucgaggcccagcagcaccugcugcagcugaccguguggggcaucaagcagcugcaggccagaauccuggccggcggc

SEQ ID NO: 31740 - RNA, 390 nt, Artificial Sequence
  derived and/or modified sequence opt4 from anti-HIV_8ANC195_LightChain
gacauccagaugacccagagccccagcacccugagcgccagcaucggcgacaccgugagaaucagcugcagagccagccagagcaucaccggcaacuggguggccugguaccagcagagacccggcaaggcccccagacugcugaucuacagaggcgccgcccugcugggcggcgugcccagcagauucagcggcagcgccgccggcaccgacuucacccugaccaucggcaaccugcaggccgaggacuucggcaccuucuacugccagcaguacgacaccuaccccggcaccuucggccagggcaccaagguggaggugaagagaaccguggccgcccccagcguguucaucuucccccccagcgacgagcagcugaagagcggcacc

SEQ ID NO: 31741 - RNA, 423 nt, Artificial Sequence
  derived and/or modified sequence opt4 from anti-HIV_8ANC195_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagaaccugaccagcgacgacaccgccguguacuucugcaccaccaccagcaccuacgacaaguggagcggccugcaccacgacggcgugauggccuucagcagcuggggccagggcacccugaucagcgugagcgccgccagcaccaagggccccagcguguuc

SEQ ID NO: 31742 - RNA, 333 nt, Artificial Sequence
  derived and/or modified sequence opt4 from anti-HIV_CAP256-VRC26.01_LightChain
cagagcgugcugacccagccccccagcgugagcgccgcccccggccagaaggugaccaucagcugcagcggcagcagcagcaccaucggcaacaacuacgugagcugguacagacugcugcccggcaccgcccccaagcugcugaucuacaagaacgacaacagacccagcggcauccccgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 31743 - RNA, 432 nt, Artificial Sequence
  derived and/or modified sequence opt4 from anti-HIV_CAP256-VRC26.01_HeavyChain
gaggugcaggugguggagagcggcggcggcguggugcagcccggcagaagccugagacugagcugcaccgccagcggcuucaccuucagcaacuucgccaugggcugggugagacaggcccccggcaagggccuggaguggguggccuucaucagcagcgacggcagcaacaagaacuacggcgacagcgugaagggcagauucaccaucagcagagacaacagcaagaacaccguguuccugcagaugaacagccugagaguggaggacaccgcccuguacuacugcgccaaggacgugggcgacuacaagagcgacgaguggggcaccgaguacuacgacaucagcaucagcuaccccauccaggaccccagagccauggugggcgccuucgaccuguggggccagggcaccauggugaccgugagcccc

SEQ ID NO: 31744 - RNA, 324 nt, Artificial Sequence
  derived and/or modified sequence opt4 from anti-HIV_CAP256-VRC26.02_LightChain
cagagcgugcugacccagccccccagcgugagcgccgcccccggccagaaggugaccaucagcugcagcggcagcaacagcaacaucggcaacaaggacgugagcugguaccagcagauccccgccaccgcccccaagcugcugaucuacgagaacaacaagagacccagcggcaucagcgacagauucagcggcagcaagagcggcaccagcgccacccuggccaucaccggccugcagaccggcgacgaggccgacuacuacugcgccaccugggacggcagagugagcgugaucggcaccggcaccaacgugaucgugcug

SEQ ID NO: 31745 - RNA, 432 nt, Artificial Sequence
  derived and/or modified sequence opt4 from anti-HIV_CAP256-VRC26.02_HeavyChain
gaggugcagcugguggagagcggcggcggcguggugcagcccggcagaagccugagacugagcugcgccgccagccaguucagcuucggcaacuacggcaugcacugggugagacaggcccccggcaagggccuggaguggguggccgccaucagcuucgccggcaccaagaccaacuacgccgacagcgugaagggcagauucaccaucagcagagacaacagcaagaacaccguguaccugcagaugaacagccugagagccgaggacaccgcccuguacuucugcgccaaggacaucagagaguacgagugcgaguacuggaccagcgacuacuacgacuucggcagaccccagcccugcaucgacagcagaggcguggugggcaccuucgacguguggggccagggcaccauggugaccgugagcagc

SEQ ID NO: 31746 - RNA, 333 nt, Artificial Sequence
  derived and/or modified sequence opt4 from anti-HIV_CAP256-VRC26.03_LightChain
cagagcgugcugacccagccccccagcgugagcgccgcccccggccagaaggugaccaucagcugcagcggcagcagcagcaacaucggcaacaacuucgugagcugguaccagcagagacccggcaccgcccccaagauccugaucuacgagaacaacaagagacccagcgagacccccgacagauucagcggcagcaagagcggcaccagcgccacccuggccaucaccggccugcagaccgccgacgaggccgaguacuacugcgccaccuggagcgccagccugagcagcgccagaguguucggcaccggcaccagaaucaccgugcug

SEQ ID NO: 31747 - RNA, 432 nt, Artificial Sequence
  derived and/or modified sequence opt4 from anti-HIV_CAP256-VRC26.03_HeavyChain
gaggugcagcugguggagagcggcggcggcguggugcagcccggcaagagccugagacugagcugcgccgccagcagauucagcuucaacagauacggcaugcacugggugagacaggcccccggcaagggccuggaguggguggccgccaucagcuacgacggcaccgacaaguaccacgccgacaagguguggggcagauucaccaucagcagagacaacagcaagaacacccuguaccugcagaugaacagccugagagccgaggacaccgcccuguacuacugcgccaaggaccugagagaggacgagugcgaggagugguggagcgacuacuacgacuucggcaagcagcugcccugcagaaagagcagaggcguggccggcaucuucgacggcuggggccagggcaccauggugaccgugagcagc

SEQ ID NO: 31748 - RNA, 333 nt, Artificial Sequence
  derived and/or modified sequence opt4 from anti-HIV_CAP256-VRC26.04_LightChain
cagcccgugcugacccagccccccagcgugagcgccgcccccggccagaaggugaccaucagcugcagcggcagcagcagcaacaucggcaacaacuucgugagcugguaccagcagagacccggcaccgcccccagccugcugaucuacgagaccaacaagagacccagcggcauccccgacagauucagcggcagcaagagcgccaccagcgccacccuggccaucaccggccugcagaccggcgacgaggccgacuacuacugcgccaccugggccgccagccugaccagcgccagaguguucggcaccggcaccaaggugaucgugagc

SEQ ID NO: 31749 - RNA, 432 nt, Artificial Sequence
  derived and/or modified sequence opt4 from anti-HIV_CAP256-VRC26.04_HeavyChain
gaggugcagcugguggagagcggcggcggcguggugcagcccggcaagagccugagacugagcugcgccgccagccaguucagcuucaacagauacggcaugcacugggugagacaggcccccggcaagggccuggaguggguggccgccaucagcuacgacggcaccgacaaguaccacgccgacaagguguggggcagauucaccaucagcagagacaacagcaagaacacccuguaccugcagaugaacagccugagagccgaggacaccgcccuguacuacugcgccaaggaccugagagaggacgagugcgaggagugguggagcgacuacuacgacuucggcaagcagcugcccugcagaaagagcagaggcguggccggcaucuucgacaaguggggccagggcaccauggugaucgugagcagc

SEQ ID NO: 31750 - RNA, 324 nt, Artificial Sequence
  derived and/or modified sequence opt4 from anti-HIV_CAP256-VRC26.05_LightChain
cagagcgcccugacccagccccccagcgugagcgccgcccccggccagaaggugaccaucagcugcagcggcaacaucggcaacaacuacgugagcugguaccagcaggugcccggcaccgcccccaagcugcugaucuacgagaacaacaagagacccagcggcauccccgacagauucagcggcagcaagagcggcaccagcgccacccuggugaucaccggccugcagaccggcgacgaggccgacuucuacugcggcaccuggggcggcagccugagaaccggcggcgugcugggcaccggcaccagagugaccgugcug

SEQ ID NO: 31751 - RNA, 432 nt, Artificial Sequence
  derived and/or modified sequence opt4 from anti-HIV_CAP256-VRC26.05_HeavyChain
gaggugcagcugguggagagcggcggcggcguggugcagcccggcagaagccugagacugagcugcgccgccagccacuucagccugagcagcuacggcaugcacugggugagacaggcccccggcaagggccuggagugggugaccggcaucagcuucgccggcaccaagaccuacuacggcgacagcgugagaggcagauucaccgugagcagagacaucagcaagaacacccuguuccugcagaugaacagccugagacccgacgacaccgccauguacuacugcgccagagaccagagauacuacgagugcgaggagugggccagcgacuacuacgacuucggcagagagcagcccugccuggaccccagaggcguggugggcaucuucgaccuguggggccagggcaccauggugaccgugagcagc

SEQ ID NO: 31752 - RNA, 324 nt, Artificial Sequence
  derived and/or modified sequence opt4 from anti-HIV_CAP256-VRC26.06_LightChain
cagagcgugcugacccagccccccagcgugagcgccgcccccggccagaaggugaccaucagcugcagcggcagcaccagcaagaucggccagaacagcgugagcugguaccagcagcugcccggcaccgcccccaagcugcugaucuacgagaacgacagaagacccagcggcacccccgacagauucagcggcagcaagagcggcaccagcgccacccuggccaucaccggccugcagaccggcgacgaggccgaguacuacugcgagaccugggacggcagcggcggcguguucggcaccggcaccaaggugaccgugcug

SEQ ID NO: 31753 - RNA, 435 nt, Artificial Sequence
  derived and/or modified sequence opt4 from anti-HIV_CAP256-VRC26.06_HeavyChain
gaggugcagcugaucgagagcggcggcggcguggugcagcccggcagaagccugagacugagcugcggcgccagcggcuucagcuucaacaacuacggcaugcacugggugagacaggcccccggcaagggccuggaguggguggccggcaucagcuucgccggcaucaagaaguacuacggcaccagcgugaagggcagauucaccaucagcagagacaacagcaagaacaacuucuaccugcagaugaacagccugagaguggaggacaccgcccuguacuacugcgccagagaccugagagagcuggagugcgaggaguggacccuguacaacuacuacgacuucggcagcagaggccccugcguggaccccagaggcguggccggcagcuucgacguguggggccagggcaccauggugaccgugagcagc

SEQ ID NO: 31754 - RNA, 333 nt, Artificial Sequence
  derived and/or modified sequence opt4 from anti-HIV_CAP256-VRC26.07_LightChain
caggccgugcugacccagccccccagcgugagcgccgcccccggccagaacgugaccaucagcugcagcggcagcggcagcaacaucggcaacaacuucgugagcugguaccagcagagacccggcaccgcccccaagcugcugaucuacgagagcaacaagagacccagcggcauccccgacagauucagcggcagcaagagcggcaccagcgccacccuggccaucaccggccugcagaccggcgacgaggccuacuacuacugcgccaccugggccgccagacugaacagcgccagaguguucggcaccggcaccauggugaccgugcug

SEQ ID NO: 31755 - RNA, 432 nt, Artificial Sequence
  derived and/or modified sequence opt4 from anti-HIV_CAP256-VRC26.07_HeavyChain
gaggugcagcugguggagagcggcggcggcguggugcagcccggcagaagccugagacugagcugcgugggcagccaguucagcuucaacagauacggcaugcacugggugagacaggcccccggcaagggccuggaguggguggccggcaucagcuucgacggcaccgacagauaccacgccgacaacguguggggcagauucaccaucagcagagacaacagcaagaacacccuguaccugcagaugagcagccugagagccgaggacaccgcccuguacuacugcgccaaggaccugagagaggacgagugcgaggagugguggagcgacuacuacgacuucggcaagaagcugcccugcagaaagagcagaggcguggccggcguguucgacaaguggggccagggcaccauggugaccgugagcagc

SEQ ID NO: 31756 - RNA, 333 nt, Artificial Sequence
  derived and/or modified sequence opt4 from anti-HIV_CAP256-VRC26.08_LightChain
cagagcgcccugacccagccccccagcgugagcgccgcccccggccagaaggugaccaucagcugcagcggcaacagcagcaacaucggcaacaacuucgugagcugguaccagcaggugcccggcaccgcccccaagcugcugcuguacgagaccuacagaagacccagcggcauccccgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 31757 - RNA, 438 nt, Artificial Sequence
  derived and/or modified sequence opt4 from anti-HIV_CAP256-VRC26.08_HeavyChain
gaggugcagcugguggagagcggcggcggcguggugcagcccggcagaagccugacccugagcugcgccgccagccaguucaccuucagcaacuacggcaugcacugggugagacaggcccccggcaagggccuggaguggguggccagcgugagcaacgacggcaccaagaaguaccacggcgacagcguguggggcagauucaccaucagcagagacaacagcaagaacacccuguuccugcagaugagcagccugagagccgaggacaccgccguguacuucugcgugagagaccagagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 31758 - RNA, 333 nt, Artificial Sequence
  derived and/or modified sequence opt4 from anti-HIV_CAP256-VRC26.09_LightChain
cagagcgcccugacccagccccccagcgugagcgccgcccccggccagaaggugaccaucagcugcagcggcaacagcagcaacaucggcaacaacuucgugagcugguaccagcagcugcccggcaccgcccccaagcugcugaucuacgagaacaacagaagacccagcggcauccccgacagauucagcggcagcaagagcggcaccagcgccacccuggccaucagcggccugcagaccggcgacgaggccgacuacuggugcgccguguggggcgugagaagaggcgccggcgccguguucggcgccggcaccaaggugaccgugcug

SEQ ID NO: 31759 - RNA, 438 nt, Artificial Sequence
  derived and/or modified sequence opt4 from anti-HIV_CAP256-VRC26.09_HeavyChain
gaggugcagcugguggagagcggcggcggcguggugcagcccggcagaagccugacccugagcugcgccgccagccaguucaacuucgccaacuacggcaugcacugggugagacaggcccccggcaagggccuggaguggguggccagcaucagcaacgacggcaccaagaaguaccacgaggagagcguguggggcagauucaccaucagcaaggacaacagcaagagcacccuguuccugcagaugaacagccugagaaucgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 31760 - RNA, 333 nt, Artificial Sequence
  derived and/or modified sequence opt4 from anti-HIV_CAP256-VRC26.10_LightChain
cagagcgugcugacccagccccccagcgugagcgccgcccccggccagaaggugaccaucagcugcagcggcagcagcagcaacaucggcgacaacuacgugagcugguaccagcaccugcccggcaccgcccccaagcugcugaucuacgagaacaccagaagacccagcggcauccccgacagauucagcggcagcaagagcggcaccagcgccacccuggccaucaccggccugcagaccggcgacgaggccgacuacuacugcggcaccugggacgugagacccaacagaggcgccguguucggcaccggcaccaaggugaccgugcug

SEQ ID NO: 31761 - RNA, 432 nt, Artificial Sequence
  derived and/or modified sequence opt4 from anti-HIV_CAP256-VRC26.10_HeavyChain
caggccauccugguggagagcggcggcggcguggugcagcccggcagaagccugagacugagcugcgccgccagccaguucaccuucagcggccacggccugcacugggugagacaggcccccggcaagggccuggaguggguggccagcaucagcuucgccggcaccaagauggacuacgccgacagcgugaagggcagauucgccaucagcagagacaacagcaagaacacccuguaccugcagaugaacagccugagaguggaggacaccgcccuguacuacugcgccaaggacaugagagaguacgagugcgaguacuggaccagcgacuacuacgacuucggcagaccccagcccugcaucgacagaagaggcguggugggcaucuucgacauguggggccagggcaccauggugaccgugagcacc

SEQ ID NO: 31762 - RNA, 321 nt, Artificial Sequence
  derived and/or modified sequence opt4 from anti-HIV_CAP256-VRC26.11_LightChain
cagagcgugcugacccagccccccagcgugagcgccgcccccggccagaacgugaccaucagcugcagcggcccccccagccacaucgagaagaacgacgugagcugguaccagagacugcccggcauggcccccaagauggugaucuacgagagcaagagaagaccccugggcauccccgugagauucagcgccagcagaagcggcagcagcgccacccuggugaucaccggccugcagaccgccgacgaggccgacuacuacugcggcaccugggacggcagaaugaacuucggcaccggcaccaccgugagcgugcug

SEQ ID NO: 31763 - RNA, 429 nt, Artificial Sequence
  derived and/or modified sequence opt4 from anti-HIV_CAP256-VRC26.11_HeavyChain
gaggugcagcugguggagagcggcggcggcguggugccccccggcaagagccugacccugagcugcguggccagcagauucaccuucagcgccuucggcaugcacugggugagacaggcccccggcaagggccuggaguggguggccagcaucagcuucgccggcaucaagaaguacuacgccgacagcgugaagggcagauucagcaucagcagagacaacagcaacacccuguuccugcagaugaacggccugagaggcgaggacaccggccuguaccacugcgugaaggacaugagagagcuggagugcgaggagugggccagcgacuacuacgacuucggcaagccccagcccugccuggacagaagaggcgugagcggcaucagcgccugguggggccccggcaccauggugaccgugagcagc

SEQ ID NO: 31764 - RNA, 321 nt, Artificial Sequence
  derived and/or modified sequence opt4 from anti-HIV_CAP256-VRC26.12_LightChain
cagagcgugcugacccagccccccagcgugagcaccgcccccggccagaccgugaccgugagcugcagcggcggcaccagcaacaccggcaacaacuucgugagcugguaccagcaccugcccggcaccgcccccaagcugcugaucuacgagaacaacaagagaccccugggcgugcccgacagauucagcggcgccaagagcggcaccagcgccacccuggccaucaccggccugcagaccggcgacgagggcgacuacuacugcgccaccuggagcggcagccugaacaucggcaccggcaccaaggugagcgugcug

SEQ ID NO: 31765 - RNA, 432 nt, Artificial Sequence
  derived and/or modified sequence opt4 from anti-HIV_CAP256-VRC26.12_HeavyChain
gaggugcagcuggugcagagcggcggcggcguggugcagcccggcagaagccugagacugagcugcgccgcccccuacuucgaguucggcagauacggcuuccacugggugagacaggcccccggcaagggccuggaguggguggccagcaucagcuucgccggcagagacuacuaccacagccccagcguguggggcagauucaccaucagcagagacaacagcaagaacacccuguaccugcagaugaacagccugagaaucgaggacaccgcccuguacuucugcgccagagaccugagagagagcgagugcgaggagugggagagcgacuacuacgacuucggcaagaagggccccugcgugaagcccagaggcguggccggcggccuggaccuguggggccagggcaccauggugaucgugagcagc

SEQ ID NO: 31766 - RNA, 333 nt, Artificial Sequence
  derived and/or modified sequence opt4 from anti-HIV_CAP256-VRC26.I1_LightChain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 31767 - RNA, 432 nt, Artificial Sequence
  derived and/or modified sequence opt4 from anti-HIV_CAP256-VRC26.I1_HeavyChain
caggugcagcugguggagagcggcggcggcguggugcagcccggcagaagccugagacugagcugcgccgccagcggcuucaccuucagcaacuacgccauggacugggugagacaggcccccggcaagggccuggaguggguggccgugaucagcagcgacggcagcaacaagaacuacgccgacagcgugaagggcagauucaccaucagcagagacaacagcaagaacacccuguaccugcagaugaacagccugagagccgaggacaccgccguguacuacugcgccaaggaccugggcgagaacaagaacgacgagugggccaccgacuacuacgaccugagcaucgccuaccccgugcaggaccccagagccguggugggcgccuucgacaucuggggccagggcaccauggugaccgugagcagc

SEQ ID NO: 31768 - RNA, 333 nt, Artificial Sequence
  derived and/or modified sequence opt4 from anti-HIV_CAP256-VRC26.I2_LightChain
cagagcgugcugacccagccccccagcgugagcgccgcccccggccagaaggugaccaucagcugcagcggcagcagcagcaccaucggcaacaacuacgugagcugguaccagcugcugcccggcaccgcccccaagcugcugaucuacaagaacgacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 31769 - RNA, 432 nt, Artificial Sequence
  derived and/or modified sequence opt4 from anti-HIV_CAP256-VRC26.I2_HeavyChain
caggugcagcugguggagagcggcggcggcguggugcagcccggcagaagccugagacugagcugcgccgccagcggcuucaccuucagcaacuucgccaugggcugggugagacaggcccccggcaagggccuggaguggguggccuucaucagcagcgacggcagcaacaagaacuacggcgacagcgugaagggcagauucaccaucagcagagacaacagcaagaacacccuguuccugcagaugaacagccugagagccgaggacaccgcccuguacuacugcgccaaggacgugggcgaguacaagagcgacgagugggccaccgacuacuacgaccugagcaucgccuaccccauccaggaccccagagccauggugggcgccuucgacaucuggggccagggcaccauggugaccgugagcagc

SEQ ID NO: 31770 - RNA, 333 nt, Artificial Sequence
  derived and/or modified sequence opt4 from anti-HIV_CAP256-VRC26.UCA_LightChain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 31771 - RNA, 432 nt, Artificial Sequence
  derived and/or modified sequence opt4 from anti-HIV_CAP256-VRC26.UCA_HeavyChain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacgacuucagcaucggcuaccccggccaggaccccagaggcguggugggcgccuucgacaucuggggccagggcaccauggugaccgugagcagc

SEQ ID NO: 31772 - RNA, 324 nt, Artificial Sequence
  derived and/or modified sequence opt4 from anti-HIV_CH01_LightChain
gagaucgugcuggcccagagccccggcacccugagccugagccccggcgagagagccacccugagcugcagagccagccacaacgugcaccccaaguacuucgccugguaccagcagaagcccggccagagccccagacugcugaucuacggcggcagcaccagagccgccggcauccccggcaaguucagcggcagcggcagcggcaccgacuucacccugaccaucagcagaguggaccccgaggacuucgccguguacuacugccagcaguacggcggcagccccuacaccuucggccagggcaccaagguggagaucaag

SEQ ID NO: 31773 - RNA, 399 nt, Artificial Sequence
  derived and/or modified sequence opt4 from anti-HIV_CH01_HeavyChain
gaggugcagcugguggagagcggcgccaacguggugagacccggcggcagccugagacugagcugcaaggccagcggcuucaucuucgagaacuucggcuucagcugggugagacaggcccccggcaagggccugcaguggguggccggccugaacuggaacggcggcgacaccagauacgccgacagcgugaagggcagauucagaaugagcagagacaacagcagaaacuucguguaccuggacauggacaaggugggcguggacgacaccgccuucuacuacugcgccagaggcaccgacuacaccaucgacgacgccggcauccacuaccagggcagcggcaccuucugguacuucgaccuguggggcagaggcacccuggugagcgugagcagc

SEQ ID NO: 31774 - RNA, 324 nt, Artificial Sequence
  derived and/or modified sequence opt4 from anti-HIV_CH02_LightChain
gagaucgugcugacccagagccccgccacccugagcgugagccccggcgagagagccacccugagcugcagagccagccagaacgugcaccccagauacuucgccugguaccagcagaagagaggccagagccccagacugcugauccacagcggcagcaccagagccgccggcaucgccgacagauucagcggcggcggcagcggcaugcacuucacccugaccaucaccagaguggagcccgaggacuucgccguguacuucugccagcaguacggcggcagccccuacaccuucggccagggcaccagaguggagcugaga

SEQ ID NO: 31775 - RNA, 399 nt, Artificial Sequence
  derived and/or modified sequence opt4 from anti-HIV_CH02_HeavyChain
gaggugcagcugguggagagcggcggcagcguggugagacccggcggcagccugagacugagcugcagagccagcggcuucaucuucgagaacuacggccugaccugggugagacaggugcccggcaagggccugcacugggugagcggcaugaacuggaacggcggcgacaccagauacgccgacagcgugagaggcagauucagcaugagcagagacaacagcaacaacaucgccuaccugcagaugaacaaccugagaguggaggacaccgcccuguacuacugcgccagaggcaccgacuacaccaucgacgaccagggcagauucuaccagggcagcggcaccuucugguacuucgacuucuggggcagaggcacccuggugaccgugagcagc

SEQ ID NO: 31776 - RNA, 324 nt, Artificial Sequence
  derived and/or modified sequence opt4 from anti-HIV_CH03_LightChain
gagaucgugcugacccagagccccgccacccugagccugagccccggcgagagagccacccugagcugcagagccagccagagcgugcaccccaaguacuucgccugguaccagcagaagcccggccagagccccagacugcugaucuacagcggcagcaccagagccgccggcaucgccgacagauucagcggcggcggcagcggcauccacuucacccugaccaucaccagaguggagcccgaggacuucgccguguacuucugccagcaguacggcggcagccccuacaccuucggccagggcaccaagguggagcugaga

SEQ ID NO: 31777 - RNA, 399 nt, Artificial Sequence
  derived and/or modified sequence opt4 from anti-HIV_CH03_HeavyChain
gaggugcagcugguggagagcggcggcggcguggugagacccggcggcagccugagacugagcugcgccgccagcggcuucaucuucgagaacuacggccugaccugggugagacaggugcccggcaagggccugcacugggugagcggcaugaacuggaacggcggcgacaccagauacgccgacagcgugagaggcagauucagcaugagcagagacaacagcaacaacaucgccuaccugcagaugaagaaccugagaguggacgacaccgcccuguacuacugcgccagaggcaccgacuacaccaucgacgaccagggcaucuucuacaagggcagcggcaccuucugguacuucgaccuguggggcagaggcacccuggugaccgugagcagc

SEQ ID NO: 31778 - RNA, 324 nt, Artificial Sequence
  derived and/or modified sequence opt4 from anti-HIV_CH04_LightChain
gagaucgugcugacccagagccccgacacccugagccugagccccggcgagagagccacccugagcugcagagccagccagagcgugcacagcagauacuucgccugguaccagcacaagcccggccagccccccagacugcugaucuacggcggcagcaccagagccaccggcauccccaacagauucagcgccggcggcagcggcacccaguucacccugaccgugaacagacuggaggccgaggacuucgccguguacuacugccagcaguacggcagaagccccuacaccuucggccagggcaccaagguggagaucaga

SEQ ID NO: 31779 - RNA, 399 nt, Artificial Sequence
  derived and/or modified sequence opt4 from anti-HIV_CH04_HeavyChain
gaggugcagcugguggagagcggcggcggccugaucagacccggcggcagccugagacugagcugcaagggcagcggcuucaucuucgagaacuucggcuucggcugggugagacagggccccggcaagggccuggagugggugagcggcaccaacuggaacggcggcgacagcagauacggcgacagcgugaagggcagauucaccaucagcagagacaacagcaacaacuucguguaccugcagaugaacagccugagacccgaggacaccgccaucuacuacugcgccagaggcaccgacuacaccaucgacgaccagggcaucagauaccagggcagcggcaccuucugguacuucgacguguggggcagaggcacccuggugaccgugagcagc

SEQ ID NO: 31780 - RNA, 627 nt, Artificial Sequence
  derived and/or modified sequence opt4 from anti-HIV_CH103_LightChain
uacgagcugacccagccccccagcgugagcgugagccccggccagaccgccaccaucaccugcagcggcgccagcaccaacgugugcugguaccaggugaagcccggccagagccccgagguggugaucuucgagaacuacaagagacccagcggcauccccgacagauucagcggcagcaagagcggcagcaccgccacccugaccaucagaggcacccaggccaucgacgaggccgacuacuacugccaggugugggacagcuucagcaccuucguguucggcagcggcacccaggugaccgugcugagacagcccaaggccaaccccaccgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31781 - RNA, 678 nt, Artificial Sequence
  derived and/or modified sequence opt4 from anti-HIV_CH103_HeavyChain
caggugcagcugcaggagagcggccccggcguggugaagagcagcgagacccugagccugaccugcaccgugagcggcggcagcaugggcggcaccuacuggagcuggcugagacugagccccggcaagggccuggaguggaucggcuacaucuuccacaccggcgagaccaacuacagccccagccugaagggcagagugagcaucagcguggacaccagcgaggaccaguucagccugagacugagaagcgugaccgccgccgacaccgccguguacuucugcgccagccugcccagaggccagcuggugaacgccuacuucagaaacuggggcagaggcagccuggugagcgugaccgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaag

SEQ ID NO: 31782 - RNA, 321 nt, Artificial Sequence
  derived and/or modified sequence opt4 from anti-HIV_M66.6_LightChain
gacauccagcugacccagagccccagcagccugagcgccagcgugggcgacagagugaccaucaccugcagagccagccagagcaucggcagcuaccugaacugguaccagcagaagcccggcaaggcccccaagcugcugaucuacgccgccagcacccugcagagcggcgugcccagcagauucagcggcagcggcagcggcaccgacuucacccugaccaucagcagccugcagcccgaggacagcgccaccuacuacugccagcagagcuacagcacccccuucaccuucggccccggcaccaagguggacaucaga

SEQ ID NO: 31783 - RNA, 390 nt, Artificial Sequence
  derived and/or modified sequence opt4 from anti-HIV_M66.6_HeavyChain
caggugcagcuggugcagagcggcgccgaggugaagaagcccggcgagagccugaagaucagcugcaaggugagcggcuacaacuucgccagcgaguggaucggcugggugagacagaugcccggcaagggccuggaguggaugggcaucaucuaccccggcgacagcgacaccaaguacagccccagcuuccagggccaggugaucaucagcgccgacaagagcaucaacaccgccuaccugcaguggagcagccugaaggccagcgacaccgccaucuacuacugcgccagacagaaccacuacggcagcggcagcuacuucuacagaaccgccuacuacuacgccauggacguguggggccagggcaccaccgugaccgugagcagc

SEQ ID NO: 31784 - RNA, 327 nt, Artificial Sequence
  derived and/or modified sequence opt4 from anti-HIV_NIH45-46_LightChain
gagaucgugcugacccagagccccgccacccugagccugagccccggcgagaccgccaucaucagcugcagaaccagccagagcggcagccuggccugguaccagcagagacccggccaggcccccagacuggugaucuacagcggcagcaccagagccgccggcauccccgacagauucagcggcagcagauggggcgccgacuacaaccugagcaucagcaaccuggagagcggcgacuucggcguguacuacugccagcaguacgaguucuucggccagggcaccaaggugcagguggacaucaagagaaccguggccgccccc

SEQ ID NO: 31785 - RNA, 399 nt, Artificial Sequence
  derived and/or modified sequence opt4 from anti-HIV_NIH45-46_HeavyChain
caggugagacugagccagagcggcggccagaugaagaagcccggcgagagcaugagacugagcugcagagccagcggcuacgaguuccugaacugccccaucaacuggaucagacuggcccccggcagaagacccgaguggaugggcuggcugaagcccagaggcggcgccgugaacuacgccagaaaguuccagggcagagugaccaugaccagagacguguacagcgacaccgccuuccuggagcugagaagccugaccagcgacgacaccgccguguacuucugcaccagaggcaaguacugcaccgccagagacuacuacaacugggacuucgagcacuggggcagaggcgcccccgugaccgugagcagcgccagcaccaagggccccagcgug

SEQ ID NO: 31786 - RNA, 330 nt, Artificial Sequence
  derived and/or modified sequence opt4 from anti-HIV_PG16_LightChain
cagagcgcccugacccagcccgccagcgugagcggcagccccggccagaccaucaccaucagcugcaacggcaccagcagcgacgugggcggcuucgacagcgugagcugguaccagcagagccccggcaaggcccccaaggugaugguguucgacgugagccacagacccagcggcaucagcaacagauucagcggcagcaagagcggcaacaccgccagccugaccaucagcggccugcacaucgaggacgagggcgacuacuucugcagcagccugaccgacagaagccacagaaucuucggcggcggcaccaaggugaccgugcug

SEQ ID NO: 31787 - RNA, 411 nt, Artificial Sequence
  derived and/or modified sequence opt4 from anti-HIV_PG16_HeavyChain
caggagcagcugguggagagcggcggcggcguggugcagcccggcggcagccugagacugagcugccuggccagcggcuucaccuuccacaaguacggcaugcacugggugagacaggcccccggcaagggccuggaguggguggcccugaucagcgacgacggcaugagaaaguaccacagcgacagcauguggggcagagugaccaucagcagagacaacagcaagaacacccuguaccugcaguucagcagccugaagguggaggacaccgccauguucuucugcgccagagaggccggcggccccaucuggcacgacgacgugaaguacuacgacuucaacgacggcuacuacaacuaccacuacauggacguguggggcaagggcaccaccgugaccgugagcagc

SEQ ID NO: 31788 - RNA, 315 nt, Artificial Sequence
  derived and/or modified sequence opt4 from anti-HIV_PGT122_LightChain
accuucgugagcguggcccccggccagaccgccagaaucaccugcggcgaggagagccugggcagcagaagcgugaucugguaccagcagagacccggccaggcccccagccugaucaucuacaacaacaacgacagacccagcggcauccccgacagauucagcggcagccccggcagcaccuucggcaccaccgccacccugaccaucaccagcguggaggccggcgacgaggccgacuacuacugccacaucugggacagcagaagacccaccaacuggguguucggcgagggcaccacccugaucgugcug

SEQ ID NO: 31789 - RNA, 396 nt, Artificial Sequence
  derived and/or modified sequence opt4 from anti-HIV_PGT122_HeavyChain
caggugcaccugcaggagagcggccccggccuggugaagcccagcgagacccugagccugaccugcaacgugagcggcacccuggugagagacaacuacuggagcuggaucagacagccccugggcaagcagcccgaguggaucggcuacgugcacgacagcggcgacaccaacuacaaccccagccugaagagcagagugcaccugagccuggacaagagcaagaaccuggugagccugagacugaccggcgugaccgccgccgacagcgccaucuacuacugcgccaccaccaagcacggcagaagaaucuacggcgugguggccuucaaggagugguucaccuacuucuacauggacguguggggcaagggcaccagcgugaccgugagcagc

SEQ ID NO: 31790 - RNA, 315 nt, Artificial Sequence
  derived and/or modified sequence opt4 from anti-HIV_PGT123_LightChain
agcagcaugagcgugagccccggcgagaccgccaagaucagcugcggcaaggagagcaucggcagcagagccgugcagugguaccagcagaagcccggccagccccccagccugaucaucuacaacaaccaggacagacccgccggcgugcccgagagauucagcgccagccccgacuucagacccggcaccaccgccacccugaccaucaccaacguggacgccgaggacgaggccgacuacuacugccacaucuacgacgccagaggcggcaccaacuggguguucgacagaggcaccacccugaccgugcug

SEQ ID NO: 31791 - RNA, 396 nt, Artificial Sequence
  derived and/or modified sequence opt4 from anti-HIV_PGT123_HeavyChain
cagcugcaccugcaggagagcggccccggccuggugaagccccccgagacccugagccugaccugcagcgugagcggcgccagcaucaacgacgccuacuggagcuggaucagacagagccccggcaagagacccgagugggugggcuacgugcaccacagcggcgacaccaacuacaaccccagccugaagagaagagugaccuucagccuggacaccgccaagaacgaggugagccugaagcugguggaccugaccgccgccgacagcgccaccuacuucugcgccagagcccugcacggcaagagaaucuacggcaucguggcccugggcgagcuguucaccuacuucuacauggacguguggggcaagggcaccgccgugaccgugagcagc

SEQ ID NO: 31792 - RNA, 315 nt, Artificial Sequence
  derived and/or modified sequence opt4 from anti-HIV_PGT125_LightChain
cagagcgcccugacccagccccccagcgccagcggcagccccggccagagcaucaccaucagcugcaacggcaccgccaccaacuucgugagcugguaccagcaguuccccgacaaggcccccaagcugaucaucuucggcguggacaagagaccccccggcgugcccgacagauucagcggcagcagaagcggcaccaccgccagccugaccgugagcagacugcagaccgacgacgaggccguguacuacugcggcagccuggugggcaacugggacgugaucuucggcggcggcaccacccugaccgugcug

SEQ ID NO: 31793 - RNA, 411 nt, Artificial Sequence
  derived and/or modified sequence opt4 from anti-HIV_PGT125_HeavyChain
cagagccagcugcaggagagcggccccagacugguggaggccagcgagacccugagccugaccugcaacgugagcggcgagagcaccggcgccugcaccuacuucuggggcugggugagacaggcccccggcaagggccuggaguggaucggcagccugagccacugccagagcuucuggggcagcggcuggaccuuccacaaccccagccugaagagcagacugaccaucagccuggacacccccaagaaccagguguuccugaagcugaccagccugaccgccgccgacaccgccaccuacuacugcgccagauucgacggcgaggugcugguguacaaccacuggcccaagcccgccuggguggaccuguggggcagaggcauccccgugaccgugaccgugagcagc

SEQ ID NO: 31794 - RNA, 315 nt, Artificial Sequence
  derived and/or modified sequence opt4 from anti-HIV_PGT126_LightChain
cagagcgcccugacccagccccccagcgccagcggcagccccggccagagcaucagcaucagcugcaccggcaccagcaacagauucgugagcugguaccagcagcaccccggcaaggcccccaagcuggugaucuacggcgugaacaagagacccagcggcgugcccgacagauucagcggcagcaagagcggcaacaccgccagccugaccgugagcggccugcagaccgacgacgaggccguguacuacugcagcagccuggugggcaacugggacgugaucuucggcggcggcaccaagcugaccgugcug

SEQ ID NO: 31795 - RNA, 411 nt, Artificial Sequence
  derived and/or modified sequence opt4 from anti-HIV_PGT126_HeavyChain
cagccccagcugcaggagagcggccccggccugguggaggccagcgagacccugagccugaccugcaccgugagcggcgacagcaccgccgccugcgacuacuucuggggcugggugagacagccccccggcaagggccuggaguggaucggcggccugagccacugcgccggcuacuacaacaccggcuggaccuaccacaaccccagccugaagagcagacugaccaucagccuggacacccccaagaaccagguguuccugaagcugaacagcgugaccgccgccgacaccgccaucuacuacugcgccagauucgacggcgaggugcugguguaccacgacuggcccaagcccgccuggguggaccuguggggcagaggcacccuggugaccgugaccgugagcagc

SEQ ID NO: 31796 - RNA, 315 nt, Artificial Sequence
  derived and/or modified sequence opt4 from anti-HIV_PGT127_LightChain
cagagcgcccugacccagccccccagcgccagcggcagccccggccagagcaucaccaucagcugcaccggcaccagcaacaacuucgugagcugguaccagcaguaccccggcaaggcccccaagcuggugaucuacgaggugaacaagagacccagcggcgugcccgacagauucagcggcagcaagagcggcagcaccgccagccugaccgugagcggccugcaggccgacgacgagggcguguacuacugcagcagccuggugggcaacugggacgugaucuucggcggcggcaccaagcugaccgugcug

SEQ ID NO: 31797 - RNA, 405 nt, Artificial Sequence
  derived and/or modified sequence opt4 from anti-HIV_PGT127_HeavyChain
cagccccagcugcaggagagcggccccggccugguggaggccagcgagacccugagccugaccugcaccgugagcggcgacagcaccggcagaugcaacuacuucuggggcugggugagacagccccccggcaagggccuggaguggaucggcagccugagccacugcagaagcuacuacaacaccgacuggaccuaccacaaccccagccugaagagcagacugaccaucagccuggacacccccaagaaccagguguuccugagacugaccagcgugaccgccgccgacaccgccaccuacuacugcgccagauucggcggcgaggugcugguguacagagacuggcccaagcccgccuggguggaccuguggggcagaggcacccuggugaccgugagcagc

SEQ ID NO: 31798 - RNA, 315 nt, Artificial Sequence
  derived and/or modified sequence opt4 from anti-HIV_PGT128_LightChain
cagagcgcccugacccagccccccagcgccagcggcagccccggccagagcaucaccaucagcugcaccggcaccagcaacaacuucgugagcugguaccagcagcacgccggcaaggcccccaagcuggugaucuacgacgugaacaagagacccagcggcgugcccgacagauucagcggcagcaagagcggcaacaccgccagccugaccgugagcggccugcagaccgacgacgaggccguguacuacugcggcagccuggugggcaacugggacgugaucuucggcggcggcaccaagcugaccgugcug

SEQ ID NO: 31799 - RNA, 405 nt, Artificial Sequence
  derived and/or modified sequence opt4 from anti-HIV_PGT128_HeavyChain
cagccccagcugcaggagagcggccccacccugguggaggccagcgagacccugagccugaccugcgccgugagcggcgacagcaccgccgccugcaacagcuucuggggcugggugagacagccccccggcaagggccuggagugggugggcagccugagccacugcgccagcuacuggaacagaggcuggaccuaccacaaccccagccugaagagcagacugacccuggcccuggacacccccaagaaccugguguuccugaagcugaacagcgugaccgccgccgacaccgccaccuacuacugcgccagauucggcggcgaggugcugagauacaccgacuggcccaagcccgccuggguggaccuguggggcagaggcacccuggugaccgugagcagc

SEQ ID NO: 31800 - RNA, 330 nt, Artificial Sequence
  derived and/or modified sequence opt4 from anti-HIV_PGT130_LightChain
cagagcgcccugacccagccccccagcgccagcggcagccugggccagagcgugaccaucagcugcaacggcaccagcagcgacaucggcggcuggaacuucgugagcugguaccagcaguuccccggcagagcccccagacugaucaucuucgaggugaacaagagacccagcggcgugcccggcagauucagcggcagcaagagcggcaacagcgccagccugaccgugagcggccugcagagcgacgacgagggccaguacuucugcagcagccuguucggcagaugggacgugguguucggcggcggcaccaagcugaccgugcug

SEQ ID NO: 31801 - RNA, 387 nt, Artificial Sequence
  derived and/or modified sequence opt4 from anti-HIV_PGT130_HeavyChain
caggugcagcugcaggagagcggccccggccuggugaagcccgccgagacccugagccugaccugcagcgugagcggcgagagcaucaacaccggccacuacuacuggggcugggugagacaggugcccggcaagggccuggaguggaucggccacauccacuacaccaccgccgugcugcacaaccccagccugaagagcagacugaccaucaagaucuacacccugagaaaccagaucacccugagacugagcaacgugaccgccgccgacaccgccguguaccacugcgugagaagcggcggcgacauccuguacuacuacgaguggcagaagccccacugguucagccccuggggccccggcauccacgugaccgugagcagc

SEQ ID NO: 31802 - RNA, 330 nt, Artificial Sequence
  derived and/or modified sequence opt4 from anti-HIV_PGT131_LightChain
cagagcgcccugacccagccccccagcgccagcggcagccugggccagagccugaccaucagcugcagcggcaccggcagcgacaucggcagcuggaacuucgugagcugguaccagcaguuccccggcagagcccccaaccugaucaucuucgaggugaacagaagaagaagcggcgugcccgacagauucagcggcagcaagagcggcaacaccgccagccugaccgugagcggccugagaagcgaggacgaggccgaguacuucugcagcagccugagcggcagaugggacaucguguucggcggcggcaccaaggugaccgugcug

SEQ ID NO: 31803 - RNA, 387 nt, Artificial Sequence
  derived and/or modified sequence opt4 from anti-HIV_PGT131_HeavyChain
caggugcagcugcaggagagcggccccggccuggugaagcccagcgagacccugagccugaccugcaccgugagcggcgacagcaucaacaccggccaccacuacuggggcugggugagacaggugcccggcaagggccccgaguggaucgcccacauccacuacaacaccgccgugcugcacaaccccgcccugaagagcagagugaccaucagcaucuucacccugaagaaccugaucacccugagccugagcaacgugaccgccgccgacaccgccguguacuucugcgugagaagcggcggcgacauccuguacuacaucgaguggcagaagccccacugguucuaccccuggggccccggcauccuggugaccgugagcagc

SEQ ID NO: 31804 - RNA, 321 nt, Artificial Sequence
  derived and/or modified sequence opt4 from anti-HIV_PGT135_LightChain
gagaucgugaugacccagagccccgacacccugagcgugagccccggcgagaccgugacccugagcugcagagccagccagaacaucaacaagaaccuggccugguaccaguacaagcccggccagagccccagacuggugaucuucgagaccuacagcaagaucgccgccuuccccgccagauucguggccagcggcagcggcaccgaguucacccugaccaucaacaacaugcagagcgaggacguggccguguacuacugccagcaguacgaggaguggcccagaaccuucggccagggcaccaagguggacaucaag

SEQ ID NO: 31805 - RNA, 399 nt, Artificial Sequence
  derived and/or modified sequence opt4 from anti-HIV_PGT135_HeavyChain
cagcugcagaugcaggagagcggccccggccuggugaagcccagcgagacccugagccugagcugcaccgugagcggcgacagcaucagaggcggcgaguggggcgacaaggacuaccacuggggcugggugagacacagcgccggcaagggccuggaguggaucggcagcauccacuggagaggcaccacccacuacaaggagagccugagaagaagagugagcaugagcaucgacaccagcagaaacugguucagccugagacuggccagcgugaccgccgccgacaccgccguguacuucugcgccagacacagacaccacgacguguucaugcuggugcccaucgccggcugguucgacguguggggccccggcgugcaggugaccgugagcagc

SEQ ID NO: 31806 - RNA, 321 nt, Artificial Sequence
  derived and/or modified sequence opt4 from anti-HIV_PGT136_LightChain
gagaucgugaugacccagagcccccccacccugagcgugagccccggcgagaccgccacccugagcugcagagccagccagaacgugaagaacaaccuggccugguaccagcugaagcccggccaggcccccagacugcugaucuucgacgccagcagcagagccggcggcauccccgacagauucagcggcagcggcuacggcaccgacuucacccugaccgugaacagcgugcagagcgaggacuucggcgacuacuucugccagcaguacgaggaguggcccagaaccuucggccagggcaccaagguggacaucaag

SEQ ID NO: 31807 - RNA, 402 nt, Artificial Sequence
  derived and/or modified sequence opt4 from anti-HIV_PGT136_HeavyChain
cagcugcagcugcaggagagcggccccggccuggugaagcccagcgagacccugagccugaccugcaccgugagcggcggcagcaugagaggcaccgacuggggcgagaacgacuuccacuacggcuggaucagacagagcagcgccaagggccuggaguggaucggcagcauccacuggagaggcagaaccacccacuacaagaccagcuucagaagcagagccacccugagcaucgacaccagcaacaacagauucagccugaccuucagcuucgugaccgccgccgacaccgccguguacuacugcgccagacacaaguaccacgacaucuucagaguggugcccguggccggcugguucgaccccuggggccagggccugcuggugaccgugagcagc

SEQ ID NO: 31808 - RNA, 321 nt, Artificial Sequence
  derived and/or modified sequence opt4 from anti-HIV_PGT137_LightChain
gagaucaugaugacccagagccccgccauccugagcgugagccccggcgacagagccacccugagcugcagagccagccagagcgugaagaacaaccuggccugguaccagaagagacccggccaggcccccagacugcugaucuucgacaccagcagcagagccagcggcauccccgccagauucagcggcggcggcagcggcaccgaguucacccugaccgugaacagcaugcagagcgaggacuucgccaccuacuacugccagcaguacgaggaguggcccagaaccuucggccagggcaccaagguggagaucaag

SEQ ID NO: 31809 - RNA, 399 nt, Artificial Sequence
  derived and/or modified sequence opt4 from anti-HIV_PGT137_HeavyChain
gaggugcaccuggaggagagcggccccggccuggugagacccagcgagacccugagccugaccugcaccgccagcggcggcagcaucagaggcggcgaguggggcgacagcgacuaccacuggggcugggugagacacagccccgagaagggccuggaguggaucggcagcauccacuggagaggcaccacccacuacaacgcccccuucagaggcagaggcagacugagcaucgaccugagcagaaaccaguucagccugagacugaccagcgugaccgccgaggacaccgccguguacuacugcgugaagcacaaguaccacgacaucgugaugguggugcccaucgccggcugguucgaccccuggggccagggccugcaggugaccgugagcagc

SEQ ID NO: 31810 - RNA, 336 nt, Artificial Sequence
  derived and/or modified sequence opt4 from anti-HIV_PGT141_LightChain
gacaccguggugacccagagcccccugagccugcccgugacccccggcgaggccgccagcaugagcugcagcagcacccagagccugagacacagcaacggcgccaacuaccuggccugguaccagcacaagcccggccagagccccagacugcugaucagacugggcagccagagagccagcggcgugcccgacagauucagcggcagcggcagcggcacccacuucacccugaagaucagcagaguggaggccgaggacgccgccaucuacuacugcaugcagggccugaacagacccuggaccuucggcaagggcaccaagcuggagaucaag

SEQ ID NO: 31811 - RNA, 423 nt, Artificial Sequence
  derived and/or modified sequence opt4 from anti-HIV_PGT141_HeavyChain
caggugcagcuggugcagagcggccccgaggugaagaagcccggcagcagcgugaaggugagcugcaaggccagcggcaacaccuucagcaaguacgacgugcacugggugagacaggccaccggccagggccuggagugggugggcuggaugagccacgagggcgacaagaccgagagcgcccagagauucaagggcagagugaccuucaccagagacaccagcgccagcaccgccuacauggagcugagaggccugaccagcgacgacaccgccaucuacuacugcaccagaggcagcaagcacagacugagagacuacgugcuguacgacgacuacggccugaucaacuaccaggaguggaacgacuaccuggaguuccuggacguguggggccacggcaccgccgugaccgugagcagc

SEQ ID NO: 31812 - RNA, 336 nt, Artificial Sequence; identical to SEQ ID NO: 31810
  derived and/or modified sequence opt4 from anti-HIV_PGT142_LightChain

SEQ ID NO: 31813 - RNA, 423 nt, Artificial Sequence
  derived and/or modified sequence opt4 from anti-HIV_PGT142_HeavyChain
caggugcagcuggugcagagcggccccgaggugaagaagcccggcagcagcgugaaggugagcugcaaggccagcggcaacaccuucagcaaguacgacgugcacugggugagacaggccaccggccagggccuggagugggugggcuggaucagccacgagagagacaagaccgagagcgcccagagauucaagggcagagugaccuucaccagagacaccagcgccaccaccgccuacauggagcugagaggccugaccagcgacgacaccgccaucuacuacugcaccagaggcagcaagcacagacugagagacuacgugcuguacgacgacuacggccugaucaacuaccaggaguggaacgacuaccuggaguuccuggacguguggggccacggcaccgccgugaccgugagcagc

SEQ ID NO: 31814 - RNA, 336 nt, Artificial Sequence
  derived and/or modified sequence opt4 from anti-HIV_PGT143_LightChain
gacaccguggugacccagagcccccugagccugcccgugacccccggcgaggccgccagcaugagcugcaccagcacccagagccugagacacagcaacggcgccaacuaccuggccugguaccagcacaagcccggccagagccccagacugcugaucagacugggcagccagagagccagcggcgugcccgacagauucagcggcagcggcagcggcacccacuucacccugaagaucagcagaguggagcccgaggacgccgccaucuacuacugcaugcagggccugaacagacccuggaccuucggcaagggcaccaagcuggagaucaag

SEQ ID NO: 31815 - RNA, 423 nt, Artificial Sequence
  derived and/or modified sequence opt4 from anti-HIV_PGT143_HeavyChain
caggugcagcuggagcagagcggcgccgaggugaagaagcccggcagcagcgugaaggugagcugcaaggccagcggcaacaccuucagcaaguacgacgugcacugggugagacaggccaccggccagggccuggagugggugggcuggaugagccacgagggcgacaagaccgagagcgcccagagauucaagggcagagugaccuucaccagagacaccagcgccagcaccgccuacauggagcugagaggccugaccagcgacgacaccgccaucuacuacugcaccagaggcagcaagcacagacugagagacuacgugcuguacgacgacuacggccugaucaacuaccaggaguggaacgacuaccuggaguuccuggacguguggggccacggcaccgccgugaccgugagcagc

SEQ ID NO: 31816 - RNA, 336 nt, Artificial Sequence
  derived and/or modified sequence opt4 from anti-HIV_PGT144_LightChain
gacaccguggugacccagagcccccugagccugagcgugacccccggcgaggccgccagcaugagcugcaccagcacccagagccugagacacagcaacggcgccaacuaccuggccugguaccagcacaagcccggccagagccccagacugcugaucagacugggcagccagagagccagcggcgugcccgacagauucagcggcagcggcagcggcacccacuucacccugaagaucagcagaguggaggccgacgacgccgccaucuacuacugcaugcagggccugaacagacccuggaccuucggcaagggcaccaagcuggagaucaag

SEQ ID NO: 31817 - RNA, 423 nt, Artificial Sequence
  derived and/or modified sequence opt4 from anti-HIV_PGT144_HeavyChain
caggugcagcuggugcagagcggcgccgaggugaagaagcccggcagcagcgugaaggugagcugcaaggccagcggcaacaccuucagaaaguacgacgugcacugggugagacaggccaccggccagggccuggagugggugggcuggaugagccacgagggcgacaagaccgagagcgcccagagauucaagggcagagugagcuucaccagagacaacagcgccagcaccgccuacaucgagcugagaggccugaccagcgacgacaccgccaucuacuacugcaccggcggcagcaagcacagacugagagacuacgugcuguacgacgacuacggccugaucaaccagcaggaguggaacgacuaccuggaguuccuggacguguggggccacggcaccgccgugaccgugagcagc

SEQ ID NO: 31818 - RNA, 336 nt, Artificial Sequence
  derived and/or modified sequence opt4 from anti-HIV_PGT145_LightChain
gagguggugaucacccagagcccccuguuccugcccgugacccccggcgaggccgccagccugagcugcaagugcagccacagccugcagcacagcaccggcgccaacuaccuggccugguaccugcagagacccggccagacccccagacugcugauccaccuggccacccacagagccagcggcgugcccgacagauucagcggcagcggcagcggcaccgacuucacccugaagaucagcagaguggagagcgacgacgugggcaccuacuacugcaugcagggccugcacagccccuggaccuucggccagggcaccaagguggagaucaag

SEQ ID NO: 31819 - RNA, 420 nt, Artificial Sequence
  derived and/or modified sequence opt4 from anti-HIV_PGT145_HeavyChain
caggugcagcuggugcagagcggcgccgaggugaagaagcccggcagcagcgugaaggugagcugcaaggccagcggcaacagcuucagcaaccacgacgugcacugggugagacaggccaccggccagggccuggaguggaugggcuggaugagccacgagggcgacaagaccggccuggcccagaaguuccagggcagagugaccaucaccagagacagcggcgccagcaccguguacauggagcugagaggccugaccgccgacgacaccgccaucuacuacugccugaccggcagcaagcacagacugagagacuacuuccuguacaacgaguacggccccaacuacgaggaguggggcgacuaccuggccacccuggacguguggggccacggcaccgccgugaccgugagcagc

SEQ ID NO: 31820 - RNA, 657 nt, Artificial Sequence
  derived and/or modified sequence opt4 from anti-HIV_PGT151_LightChain
gacaucgugaugacccagaccccccugagccugagcgugacccccggccagcccgccagcaucagcugcaagagcagcgagagccugagacagagcaacggcaagaccagccuguacugguacagacagaagcccggccagagcccccagcugcugguguucgaggugagcaacagauucagcggcgugagcgacagauucgugggcagcggcagcggcaccgacuucacccugagaaucagcagaguggaggccgaggacgugggcuucuacuacugcaugcagagcaaggacuucccccugaccuucggcggcggcaccaagguggaccugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31821 - RNA, 720 nt, Artificial Sequence
  derived and/or modified sequence opt4 from anti-HIV_PGT151_HeavyChain
agagugcagcugguggagagcggcggcggcguggugcagcccggcaagagcgugagacugagcugcguggugagcgacuuccccuucagcaaguaccccauguacugggugagacaggcccccggcaagggccuggaguggguggccgccaucagcggcgacgccuggcacgugguguacagcaacagcgugcagggcagauuccuggugagcagagacaacgugaagaacacccuguaccuggagaugaacagccugaagaucgaggacaccgccguguacagaugcgccagaauguuccaggagagcggcccccccagacuggacagauggagcggcagaaacuacuacuacuacagcggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaag

SEQ ID NO: 31822 - RNA, 657 nt, Artificial Sequence
  derived and/or modified sequence opt4 from anti-HIV_PGT152_LightChain
gacaucgugaugacccagaccccccugagccugagcguggaccccggccagcccgccagcaucagcugcaagagcagccagagccugagacagagcaacggcaagaccagccuguacugguaccagcagaagcccggccagagcccccagcugcugaucuucgaggugagcaacagauucagcggcgugagcgacagauucgugggcagcggcagcggcaccgacuucacccugagaaucagcagaguggaggccgaggacgugggcuucuacuacugcaugcagagcaaggacuucccccugaccuucggcggcggcaccaagguggaccugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31823 - RNA, 720 nt, Artificial Sequence
  derived and/or modified sequence opt4 from anti-HIV_PGT152_HeavyChain
agagugcagcugguggagagcggcggcggcguggugcagcccggcaagagcgugagacugagcugcguggugagcgacuuccccuucagcaaguaccccauguacugggugagacaggcccccggcaagggccuggaguggguggccgccaucagcgccgacgccuggcacgugguguacagcggcagcgugcagggcagauuccuggugagcagagacaacagcaagaacauccuguaccuggagaugaacacccugaagaucgaggacaccgccguguacagaugcgccagaauguuccaggagagcggcccccccagauucgacagcuggagcggcagaaacuacuacuacuacagcggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaag

SEQ ID NO: 31824 - RNA, 309 nt, Artificial Sequence
  derived and/or modified sequence opt4 from anti-HIV_VRC-CH30_LightChain
gacauccagaugacccagagccccagcagccugagcgccagccugggcgacagagugaccaucaccugccaggccagcagaggcaucggcaaggaccugaacugguaccagcagaagcccggcaaggcccccaagcugcuggugagcgacgccagcauccuggagggcggcgugcccagcagauucagcggcagcggcuuccaccagaacuucagccugaccaucagcagccugcagcccgaggacguggccaccuacuucugccagcaguacgagaccuucggccagggcaccaagguggacaucaag

SEQ ID NO: 31825 - RNA, 393 nt, Artificial Sequence
  derived and/or modified sequence opt4 from anti-HIV_VRC-CH30_HeavyChain
caggugcagcuggugcagagcggcgccgccgugagaaagcccggcgccagcgugaccgugagcugcaaguucgccgaggacgacgacuacagcccccacugggugaaccccgcccccgagcacuacauccacuuccugagacaggcccccggccagcagcuggaguggcuggccuggaugaaccccaccaacggcgccgugaacuacgccuggcagcugcacggcagacugaccgccaccagagacggcagcaugaccaccgccuuccuggaggugagaagccugagaagcgacgacaccgccguguacuacugcgccagagcccagaagagaggcagaagcgagugggccuacgcccacuggggccagggcacccccguggccgugagcagc

SEQ ID NO: 31826 - RNA, 309 nt, Artificial Sequence
  derived and/or modified sequence opt4 from anti-HIV_VRC-CH31_LightChain
gacauccagaugacccagagccccagcagccugagcgccagccugggcgacagagugaccaucaccugccaggccagcagaggcaucggcaaggaccugaacugguaccagcagaaggccggcaaggcccccaagcugcuggugagcgacgccagcacccuggagggcggcgugcccagcagauucagcggcagcggcuuccaccagaacuucagccugaccaucagcagccugcaggccgaggacguggccaccuacuucugccagcaguacgagaccuucggccagggcaccaagguggacaucaag

SEQ ID NO: 31827 - RNA, 393 nt, Artificial Sequence
  derived and/or modified sequence opt4 from anti-HIV_VRC-CH31_HeavyChain
caggugcagcuggugcagagcggcgccgccgugagaaagcccggcgccagcgugaccgugagcugcaaguucgccgaggacgacgacuacagccccuacugggugaaccccgcccccgagcacuucauccacuuccugagacaggcccccggccagcagcuggaguggcuggccuggaugaaccccaccaacggcgccgugaacuacgccugguaccugaacggcagagugaccgccaccagagacagaagcaugaccaccgccuuccuggaggugaagagccugagaagcgacgacaccgccguguacuacugcgccagagcccagaagagaggcagaagcgagugggccuacgcccacuggggccagggcacccccgugguggugagcagc

SEQ ID NO: 31828 - RNA, 309 nt, Artificial Sequence
  derived and/or modified sequence opt4 from anti-HIV_VRC-CH32_LightChain
gacauccagaugacccagagccccagcagccugagcgccagccugggcgacagagugaccaucaccugccaggccagcagaggcaucggcaaggaccugaacugguaccagcagaagcccggcagagcccccaagcugcuggugagcgacgccagcauccuggagggcggcgugcccaccagauucagcggcagcggcuuccaccagaacuucagccugaccaucagcagccugcaggccgaggacguggccaccuacuucugccagcaguacgagaccuucggccagggcaccaagguggacaucaag

SEQ ID NO: 31829 - RNA, 393 nt, Artificial Sequence
  derived and/or modified sequence opt4 from anti-HIV_VRC-CH32_HeavyChain
caggugcagcuggugcagagcggcgccgccgugagaaagcccggcgccagcgugaccgugagcugcaaguucgccgaggacgacgacuucagcccccacugggugaaccccgcccccgagcacuacauccacuuccugagacaggcccccggccagcagcuggaguggcuggccuggaugaagcccaccaacggcgccgugaacuacgccuggcagcugcagggcagagugaccgugaccagagacagaagccagaccaccgccuuccuggaggugaagaaccugagaagcgacgacaccgccguguacuacugcgccagagcccagaagagaggcagaagcgagugggccuacgcccacuggggccagggcacccccguggugaucagcgcc

SEQ ID NO: 31830 - RNA, 309 nt, Artificial Sequence
  derived and/or modified sequence opt4 from anti-HIV_VRC-CH33_LightChain
gacauccagaugacccagagccccagcagccugagcgccagccugggcgacagagugaccaucaccugccaggccagcagaggcaucggcaaggaccugaacugguaccagcagaagagaggcagagcccccagacugcuggugagcgacgccagcgugcuggagggcggcgugcccagcagauucagcggcagcggcuuccaccagaacuucagccugaccaucagcacccugcagcccgaggacguggccaccuacuucugccagcaguacgagaccuucggccagggcaccaagguggacaucaag

SEQ ID NO: 31831 - RNA, 393 nt, Artificial Sequence
  derived and/or modified sequence opt4 from anti-HIV_VRC-CH33_HeavyChain
caggugcagcuggugcagagcggcgccgccgugagaaagcccggcgccagcaucagcgugagcugcaaguucgccgacgccgacgacuacagcccccacuggaugaaccccgcccccgagcacuacauccacuuccugagacaggcccccggccagcagcuggaguggcuggccuggaugaaccccaccaacggcgccgugaacuacgccugguaccugaacggcagagugaccgccaccagagacagaagcaugaccaccgccuuccuggaggugagaagccugagaagcgacgacaccgccguguacuacugcgccagagcccagaagagagccagaagcgagugggccuacgcccacuggggccagggcacccccgugguggugagcagc

SEQ ID NO: 31832 - RNA, 309 nt, Artificial Sequence
  derived and/or modified sequence opt4 from anti-HIV_VRC-CH34_LightChain
gacauccagaugacccagagccccagcagccugagcgccagccugggcgacagagugaccaucaccugccaggccagcagaggcaucggcaaggaccugaacugguaccagcagaaggccggcaaggcccccaagcugcuggugagcgacgccagcauccuggagggcggcgugcccagcagauucagcggcagcggcuuccaccagaacuucagccugaccaucagcagccugcagcccgaggacguggccaccuacuucugccagcaguacgagaccuucggccagggcaccaagguggacaucaag

SEQ ID NO: 31833 - RNA, 393 nt, Artificial Sequence
  derived and/or modified sequence opt4 from anti-HIV_VRC-CH34_HeavyChain
caggugcagcuggugcagagcggcgccgccgugagaaagcccggcgccagcgugaccgugagcugcaaguucgccgaggacgacgacuggagcccccacugggugaaccccgcccccgagcacuacauccacuuccugagacaggcccccggccagcagcuggaguggcuggccuggaugaaccccaccaacggcgccgugaacuacgccuggcagcugaacggcagacugaccgccaccagagacaccagcaugaccaccgccuuccuggaggugaagagccugagaagcgacgacaccgccguguacuacugcgccagagcccagaagagaggcagaagcgagugggccuacgcccacuggggccagggcacccccgugguggugagcagc

SEQ ID NO: 31834 - RNA, 306 nt, Artificial Sequence
  derived and/or modified sequence opt4 from anti-HIV_VRC-PG04_LightChain
gagaucgugcugacccagagccccggcacccugagccugagccccggcgagaccgccagccugagcugcaccgccgccagcuacggccacaugaccugguaccagaagaagcccggccagccccccaagcugcugaucuucgccaccagcaagagagccagcggcauccccgacagauucagcggcagccaguucggcaagcaguacacccugaccaucaccagaauggagcccgaggacuucgccagauacuacugccagcagcuggaguucuucggccagggcaccagacuggagaucagaaga

SEQ ID NO: 31835 - RNA, 375 nt, Artificial Sequence
  derived and/or modified sequence opt4 from anti-HIV_VRC-PG04_HeavyChain
caggugcagcuggugcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccgacuucagacagagagugagccugaccagagacagagaccuguucaccgcccacauggacaucagaggccugacccagggcgacaccgccaccuacuucugcgccagacagaaguucuacaccggcggccagggcugguacuucgaccuguggggcagaggcacccugaucguggugagcagc

SEQ ID NO: 31836 - RNA, 303 nt, Artificial Sequence
  derived and/or modified sequence opt4 from anti-HIV_VRC-PG04b_LightChain
gagaucgugcugacccagagccccggcacccugagccugagccccggcgagaccgccagccugagcugcaccgccgccagcuacggccacaugaccugguaccagaagaagcccggccagccccccaagcugcugaucuucgccaccagcaagagagccagcggcauccccgacagauucagcggcagccaguucggcaagcaguacacccugaccaucaccagaauggagcccgaggacuucgccggcuacuacugccagcagguggaguucuucggccagggcaccagacuggagaucaga

SEQ ID NO: 31837 - RNA, 375 nt, Artificial Sequence
  derived and/or modified sequence opt4 from anti-HIV_VRC-PG04b_HeavyChain
caggugcagcuggugcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 31838 - RNA, 612 nt, Artificial Sequence
  derived and/or modified sequence opt4 from anti-HIV_VRC-PG20_LightChain
cagagcgcccugacccagccccccagcgugagcggcagccccggccagagcaucacccugagcugcaccggcgccagcaccagcguggccugguaccagcaguacgccgacaaggcccccagacugaucguguucgacggcaacaagagacccagcgacaucagcagcagauucagcggcagccagagcggcggcaccgccagccugaccaucagcggccugcagagcgaggacgaggccuacuaccacugcaacgccuucgaguucuucggcggcggcaccaagcugaccgugcugagccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccaccgagugc

SEQ ID NO: 31839 - RNA, 681 nt, Artificial Sequence
  derived and/or modified sequence opt4 from anti-HIV_VRC-PG20_HeavyChain
gaggugcaccugaugcagagcggcaccgagaugaagaagcccggcgccagcgugagagugaccugccagaccagcggcuacaccuucagcgacuacuucauccacuggcugagacaggugcccggcagaggcuucgaguggaugggcuggaugaacccccaguggggccaggugaacuacgccagaaccuuccagggcagagugaccaugaccagagacguguacagagagguggccuaccuggaccugagaagccugaccuucgccgacaccgccguguacuucugcgccagaagaaugagaagccaggacagagagugggacuuccagcacuggggccagggcaccagaaucaucgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaag

SEQ ID NO: 31840 - RNA, 1059 nt, Artificial Sequence
  derived and/or modified sequence opt4 from anti-HIV_VRC-PG20_G-Chain
guguggaaggacgccgacaccacccuguucugcgccagcgacgccaaggcccacgagaccgaggugcacaacgugugggccacccacgccugcgugcccaccgaccccaacccccaggagauccaccuggagaacgugaccgagaacuucaacauguggaagaacaacaugguggagcagaugcaggaggacgugaucagccugugggaccagagccugcagcccugcgugaagcugaccggcggcagcgugaucaagcaggccugccccaagaucagcuucgaccccauccccauccacuacugcacccccgccggcuacgugauccugaagugcaacgacaagaacuucaacggcaccggccccugcaagaacgugagcagcgugcagugcacccacggcaucaagcccguggugagcacccagcugcugcugaacggcagccuggccgaggaggagaucaucaucagaagcgagaaccugaccaacaacgccaagaccaucaucgugcaccugaacaagagcguggagaucaacugcaccagacccagcaacggcggcagcggcagcggcggcgacaucagaaaggccuacugcgagaucaacggcaccaaguggaacaaggugcugaagcaggugaccgagaagcugaaggagcacuucaacaacaagaccaucaucuuccagccccccagcggcggcgaccuggagaucaccaugcaccacuucaacugcagaggcgaguucuucuacugcaacaccacccagcuguucaacaacaccugcaucggcaacgagaccaugaagggcugcaacggcaccaucacccugcccugcaagaucaagcagaucaucaacauguggcagggcaccggccaggccauguacgccccccccaucgacggcaagaucaacugcgugagcaacaucaccggcauccugcugaccagagacggcggcgccaacaacaccagcaacgagaccuucagacccggcggcggcaacaucaaggacaacuggagaagcgagcuguacaaguacaagguggugcagaucgag

SEQ ID NO: 31841 - RNA, 312 nt, Artificial Sequence
  derived and/or modified sequence opt4 from anti-HIV_VRC02_LightChain
gagaucgugcugacccagagccccggcacccugagccugagccccggcgagaccgccaucaucagcugcagaaccagccaguacggcagccuggccugguaccagcagagacccggccaggcccccagacuggugaucuacagcggcagcaccagagccgccggcauccccgacagauucagcggcagcagauggggccccgacuacaaccugaccaucagaaaccuggagagcggcgacuucggccuguacuacugccagcaguacgaguucuucggccagggcaccaaggugcagguggacaucaagaga

SEQ ID NO: 31842 - RNA, 363 nt, Artificial Sequence
  derived and/or modified sequence opt4 from anti-HIV_VRC02_HeavyChain
caggugcagcuggugcagagcggcggccagaugaagaagcccggcgagagcaugagaaucagcugccaggccagcggcuacgaguucaucgacugcacccugaacugggugagacuggcccccggcagaagacccgaguggaugggcuggcugaagcccagaggcggcgccgugaacuacgccagaccccugcagggcagagugaccaugaccagagacguguacagcgacaccgccuuccuggagcugagaagccugaccgccgacgacaccgccguguacuacugcaccagaggcaagaacugcgacuacaacugggacuucgagcacuggggcagaggcacccccgugaccgugagcagc

SEQ ID NO: 31843 - RNA, 309 nt, Artificial Sequence
  derived and/or modified sequence opt4 from anti-HIV_VRC03_LightChain
gagaucgugcugacccagagccccggcauccugagccugagccccggcgagaccgccacccuguucugcaaggccagccagggcggcaacgccaugaccugguaccagaagagaagaggccaggugcccagacugcugaucuacgacaccagcagaagagccagcggcgugcccgacagauucgugggcagcggcagcggcaccgacuucuuccugaccaucaacaagcuggacagagaggacuucgccguguacuacugccagcaguucgaguucuucggccugggcagcgagcuggaggugcacaga

SEQ ID NO: 31844 - RNA, 390 nt, Artificial Sequence
  derived and/or modified sequence opt4 from anti-HIV_VRC03_HeavyChain
caggugcagcuggugcagagcggcgccgugaucaagacccccggcagcagcgugaagaucagcugcagagccagcggcuacaacuucagagacuacagcauccacugggugagacugauccccgacaagggcuucgaguggaucggcuggaucaagccccuguggggcgccgugagcuacgccagacagcugcagggcagagugagcaugaccagacagcugagccaggaccccgacgaccccgacuggggcguggccuacauggaguucagcggccugacccccgccgacaccgccgaguacuucugcgugagaagaggcagcugcgacuacugcggcgacuuccccuggcaguacuggggccagggcaccguggugguggugagcagc

SEQ ID NO: 31845 - RNA, 630 nt, Artificial Sequence
  derived and/or modified sequence opt4 from anti-HIV_VRC23_LightChain
gagaucgugaugacccagagccccgugaccgugagcgugagcagaggcggcaccgccacccugagcugcagagccagccagggcgugggcagcgacguggccugguaccagcacaagcccggccagacccccagacugcugaucuacggcgccagcaccagagccagcggcgugcccgagagauucagcggcagcggcuuccacguggacuucacccugagcaucagcggccugcagcccgaggacguggccaucuacuacugccagcaguacgagaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31846 - RNA, 672 nt, Artificial Sequence
  derived and/or modified sequence opt4 from anti-HIV_VRC23_HeavyChain
gaggugcaguucgugcagagcggcgccgaggugaagaagcccggcgccagcgugagagugagcugcgaggccagcggcuacagcuucaccgacuacgugcugcaguggaucagacaggcccccggccagagacccgaguggaugggcuggaucaagcccgagagaggcgccgugagcuacgccccccaguuccagggcagacugacccugaccagagaccuguacaccgagaccgccuacaugcacuucaagaaccugagaagcgacgacaccgccaucuacuacugcgccagaggcgugagaagagacgccagcugguggcugcaguucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 31847 - RNA, 1077 nt, Artificial Sequence
  derived and/or modified sequence opt4 from anti-HIV_VRC23_G-Chain
guguggagagacgccgacaccacccuguucugcgccagcgacgccaaggccuacgagaccgagaagcacaacgugugggccacccacgccugcgugcccaccgaccccaacccccaggagauccaccuggacaacgugaccgagaaguucaacauguggaagaacaacaugguggagcagaugcacaccgacaucaucagccugugggaccagagccugaagcccugcgugaagcugaccggcggcagcgccaucacccaggccugccccaaggugagcuucgagcccauccccauccacuacugcacccccgccggcuucgccauccugaagugcaaggacgagggcuucaacggcaccggccugugcaagaacgugagcaccgugcagugcacccacggcaucaagcccguggugagcacccagcugcugcugaacggcagccuggccgagaagaacaucaccaucagaagcgagaacaucaccaacaacgccaagaucaucaucgugcagcuggugcagcccgugaccaucaagugcaucagacccaacaacggcggcagcggcagcggcggcgacaucagacaggcccacugcaacgugaccagaagcagauggaacaagacccugcaggagguggccgagaagcugagaaccuacuucggcaacaagaccaucaucuucgccaacagcagcggcggcgaccuggagaucaccacccacagcuucaacugcggcggcgaguucuucuacugcaacaccagcggccuguucaacagcaccugguacgugaacagcaccuggaacgacaccgacagcacccaggagagcaacgacaccaucacccugcccugcagaaucaagcagaucaucaacauguggcagagagccggccaggccauguacgccccccccauccccggcgugaucaagugcgagagcaacaucaccggccugcugcugaccagagacggcggcaaggacaacaacgugaacgagaccuucagacccggcggcggcgacaugagagacaacuggagaagcgagcuguacaaguacaaggugguggagaucgag

SEQ ID NO: 31848 - RNA, 648 nt, Artificial Sequence
  derived and/or modified sequence opt4 from anti-HIV_5CCK_LightChain
cagagcgcccugacccagcccgccagcgugagcgccagccccggccagagcaucaccaucagcugcagcggcaccagaagcgacgugggcggcuacgacuucgugagcugguaccagcagcaccccggcaaggugcccaagcugaucaucuacgaggugaccaagagacccagcggcaucccccagagauucagcggcagcaagagcggcaacaccgccagccugaccaucagcggccugcaggccgacgacgaggccgacuacuacugcugcagcuacgccaacuacgacaagcugauccugggcggcggcaccaagcugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacggcagccccgugaaggccggcguggagaccaccaagcccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31849 - RNA, 696 nt, Artificial Sequence
  derived and/or modified sequence opt4 from anti-HIV_5CCK_HeavyChain
caggugcagcuggugcagagcggcgccgagaugaaggaccccggcgccagcgugaaggugagcugcagagccagcggcuacaaguucaccgacuacuacaugcacugggugagacaggcccccggccagggccuggagugggugggcugggugaacaccaacggcggcuucaccaaguacggcgccaaguuccagggcagagugaccgugaccagagacaccagcaccaacaccguguuccuggagcugagcagacugaccuucggcgacaccgccauguacuucugcgccagacccaugagacccgugagccacggcaucgacuacagcggccuguucguguuccaguucuggggcagaggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgac

SEQ ID NO: 31850 - RNA, 648 nt, Artificial Sequence; identical to SEQ ID NO: 31726
  derived and/or modified sequence opt4 from anti-HIV_5AWN_LightChain

SEQ ID NO: 31851 - RNA, 696 nt, Artificial Sequence
  derived and/or modified sequence opt4 from anti-HIV_5AWN_HeavyChain
caggugcagcugaugcagagcggcgcccagcugagagaccccggcgacagccugaagaucagcugcaaggccagcggcuacaacuucaucgacuaccacauccacugggugagacuggcccccggcagaggccuggaguggaugggcuggaucgaccccgugggcggcaucaccaaguacgccggccaguuccagggcagacugagccugaccagagacaccagcaccaacacccuguuccuggagcugagcagacugaccgccggcgacaccgccguguacuucugcgccagaagcaugagacccguggaccacggcaucgacuacagcggccuguucguguuccacuucuggggcagaggcagcgacgugcuggugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgac

SEQ ID NO: 31852 - RNA, 645 nt, Artificial Sequence
  derived and/or modified sequence opt4 from anti-HIV_3QEG_LightChain
gagaucgugaugaugcagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccccgagaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31853 - RNA, 717 nt, Artificial Sequence
  derived and/or modified sequence opt4 from anti-HIV_3QEG_HeavyChain
caggugcagcuggugcagagcggcgccgaggugaagaagcccggcagcagcgugaaggugagcugcagagccagcagaggcaccuucagcagcuacggcaucaccugggugagacaggcccccggccagggccuggaguggaugggcggcaucauccccaucuucgacgugaccaacuacgcccagaacuuccagggcagaguggccaucaccaccgacgccgagaugagcaccgccuacauggagcugagaagccugaagagcgaggacagcgccguguacuacugcgccagcgacagcagagacuucagcuacuacgagcccggcaccagcuacagccacuacuacaacaucauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccac

SEQ ID NO: 31854 - RNA, 690 nt, Artificial Sequence
  derived and/or modified sequence opt4 from anti-HIV_1N0X_K-Chain
caggugcagcuggugcagagcggcgccgaggugaagaagcccggcgccagcgugaaggugagcugccaggccagcggcuacagauucagcaacuucgugauccacugggugagacaggcccccggccagagauucgaguggaugggcuggaucaaccccuacaacggcaacaaggaguucagcgccaaguuccaggacagagugaccuucaccgccgacaccagcgccaacaccgccuacauggagcugagaagccugagaagcgccgacaccgccguguacuacugcgccagagugggccccuacagcugggacgacagcccccaggacaacuacuacauggacguguggggcaagggcaccaccgugaucgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 31855 - RNA, 645 nt, Artificial Sequence
  derived and/or modified sequence opt4 from anti-HIV_1N0X_M-Chain
gagaucgugcugacccagagccccggcacccugagccugagccccggcgagagagccaccuucagcugcagaagcagccacagcaucagaagcagaagaguggccugguaccagcacaagcccggccaggcccccagacuggugauccacggcgugagcaacagagccagcggcaucagcgacagauucagcggcagcggcagcggcaccgacuucacccugaccaucaccagaguggagcccgaggacuucgcccuguacuacugccagguguacggcgccagcagcuacaccuucggccagggcaccaagcuggagagaaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagaagccccgugaccaagagcuucaacagaggcgagugc

SEQ ID NO: 31856 - RNA, 654 nt, Artificial Sequence
  derived and/or modified sequence opt4 from anti-HIV_3QEH_HeavyChain
gacaucgugaugacccagagcccccugagccugcccgugacccccggcgaggccgccagcaucagcugcagaagcagccagagccugcugcacaccaacggcuuccaguaccuggacugguaccugcagaagcccggccagagcccccagcugcugaucuaccugggcagcaacagagccaccggcgugccccacagauucagcggcagcggcagcggcaccgaguucacccugaagaucagcagaguggaggccgaggacgugggcguguacuacugcaugcaggccaaggagagccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31857 - RNA, 696 nt, Artificial Sequence
  derived and/or modified sequence opt4 from anti-HIV_3QEH_G-Chain
caggugcagcuggugcagagcggcgccgaggugagaaagcccggcgccagcgugaccgugagcugcaagaccagcggcuacaccuucgugaacuucuacaucgugugggugagacaggcccccggccagggccuggaguggaugggcgugaucaaccccuucagaggcgacaccuacuucgcccagaaguucaagggcagagugacccugaccagagacaccagcaccagcaccguguucauggagcugagcagccugagaagcgacgacaccgccaucuacuacugcgccagagaccuggagaugagagacggcaacaaccacggcagccaccuggaguucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccac

SEQ ID NO: 31858 - RNA, 678 nt, Artificial Sequence
  derived and/or modified sequence opt4 from anti-HIV_2B1H_HeavyChain
gagauccagcuggagcagagcggcgccgaggugaagaagagcggcgagagccugaagaucagcugccagaccagcggcuacagcuucagcgacuacuggaucggcugggugagacagaugcccggcaagggccuggaguggaugggcaucuucuaccccggcgacagcgacagcagauacagccccagcuucgagggccaggugaccaugagcgccgacagaagcaccaacaccgcccaccugcaguggagcagccugaagcccagcgacaccgcccuguacuacugcgccagacugggcggcgacuacgaggacagcggcgccgacgccuucgacuucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagc

SEQ ID NO: 31859 - RNA, 645 nt, Artificial Sequence
  derived and/or modified sequence opt4 from anti-HIV_2B1H_LightChain
cagagcgugcugacccagccccccagcgccagcggcacccccggccagagaaucagcaucagcugcagcggcaccagcagcaacguggagaacaacuacguguacugguaccagcaccugcccggcaccgcccccaagcugcugaucuacagaaacgaccacagaagcagcggcauccccgacagauucagcgccagcaagagcggcaccagcgccagccuggccaucagcggccugagacccgaggacgagggcgacuacuacugcgccgccugggacgacagcagaggcggccccgacuggguguucggcggcggcaccaagcugaccgugcuggcccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccacc

SEQ ID NO: 31860 - RNA, 648 nt, Artificial Sequence
  derived and/or modified sequence opt4 from anti-HIV_3TNM_B-Chain
cagagcgugcugacccagccccccagcgccagcggcagccccggccagagcgugaccaucagcugcaccggcaccagcagcgacgugggcggcuacaacuacgugagcugguaccagcaccaccccggcaaggcccccaagcugaucaucagcgaggugaacaacagacccagcggcgugcccgacagauucagcggcagcaagagcggcaacaccgccagccugaccgugagcggccugcaggccgaggacgaggccgaguacuacugcagcagcuacaccgacauccacaacuucguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31861 - RNA, 693 nt, Artificial Sequence
  derived and/or modified sequence opt4 from anti-HIV_3TNM_A-Chain
caggugcagcugcaggagagcggccccggccuggugaagcccagccagacccugagccugagcugcaccgugagcggcggcagcagcagcagcggcgcccacuacuggagcuggaucagacaguaccccggcaagggccuggaguggaucggcuacauccacuacagcggcaacaccuacuacaaccccagccugaagagcagaaucaccaucagccagcacaccagcgagaaccaguucagccugaagcugaacagcgugaccguggccgacaccgccguguacuacugcgccagaggcaccagacugagaacccugagaaacgccuucgacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacacc

SEQ ID NO: 31862 - RNA, 690 nt, Artificial Sequence
  derived and/or modified sequence opt4 from anti-HIV_3UJJ_HeavyChain
gaggugcagcuggugcagagcggcgccgaggugaagaagcccggcgagagccugaagaucagcugcaaggccagcggcuacagcuucagcagcuacuggaucgccugggugagacagaugcccggcaagggccuggaguggaugggcuucaucuaccccgccgacagcgacaccagauacagccccagcuuccagggccagggcaccaucagcgccgacaagagcaucagcaccgccuaccugcaguggagcagccugaaggccagcgacaccgccauguacuacugcgccauccugggcuucuggggcgccaacagaggcggcggcggcauggacguguggggccagggcaccaccgugaucgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacc

SEQ ID NO: 31863 - RNA, 639 nt, Artificial Sequence
  derived and/or modified sequence opt4 from anti-HIV_3UJJ_LightChain
agcuacgagcugacccagccccccagcgugagcgugagccccggccagaccgccagaaucaccugcagcggcgacgcccugcccgagaaguacgccuacugguaccagcagaagagcggccaggcccccgugcugaucaucuacgaggacagcaagagacccagcggcauccccgagagauucagcggcagcagaagcggcaccauggccacccugaccaucagcggcgcccagguggacgacgaggccgacuacuacugcuacagcaccaacagcggcggcaccuucuucguguucggcaccggcaccaaggugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugc

SEQ ID NO: 31864 - RNA, 669 nt, Artificial Sequence
  derived and/or modified sequence opt4 from anti-HIV_3UJI_HeavyChain
caggugcagcuggugcagagcgccgccgaggugaagaagcccggcgaggcccugaagaucagcugcaagggcagcggcuacagcuucagcaacuacuggaucgccugggugagacagaugcccggcaagggccuggaguggaugggcaucguguaccccgacgacagcgacagcagcuacaacagcagcuuccagggccagaucaccuucagcgccgacaagagcaucagcaccgccuaccugcacuggaccagccugcaggccagcgacaccgccauguacuacugcgccagacugggcuucgagggcgacuacagcggcagcuucuucgacuacuggggccagggcacccugcugaucgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagccc

SEQ ID NO: 31865 - RNA, 627 nt, Artificial Sequence
  derived and/or modified sequence opt4 from anti-HIV_3UJI_LightChain
agcuacgagcugacccagccccccagcgugagcgugagccccggccagaccgccagcaucaccugcagcggcgacauccugggcgacaaguacgugagcugguaccagcagaagagcggccagagcccccugcuggugaucuacgaggacaccaagagacccagcggcauccccgacagauucagcggcagcaagagcggcaacaccgccacccugaccaucagcggcacccaggccauggacgaggccgacuacuacugccaggccugggacagcacccugggcgugguguucggcggcggcaccaaggugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggccccc

SEQ ID NO: 31866 - RNA, 666 nt, Artificial Sequence
  derived and/or modified sequence opt4 from anti-HIV_2QSC_HeavyChain
caggugcagcuggugcagagcggcggcggccuggugcagcccggcggcagccugagacugagcugcgccgccuucggcuucaacuucagcagcuacgugaugcacugggugagacaggcccccggccagggccuggaguaccugagcgccaucagcagcgacggcgagaccaccuaccacgccaacagcgugaagggcagauucaccagcagcagagacaacagcaagaacacccuguuccugcagaugggcagccugagaaccgaggacguggccguguacuacugcgccagagacagauacuacgagaccagcggcagcaacgccuucgacguguggggccagggcaccauggugguggugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggag

SEQ ID NO: 31867 - RNA, 645 nt, Artificial Sequence
  derived and/or modified sequence opt4 from anti-HIV_2QSC_LightChain
aacagcgugcugacccagagccccagcagccugagcgccagcgugggcgacagagugaccaucaccugccaggccagccaggacaucagcaacuaccugaacugguaccagcacaagcccggcaaggcccccaagcugcugaucuacaccgccagcaaccuggagaccggcgugcccagcagauucagcggcggcggcagcggcacccacuucagcuucaccaucaccagccugcagcccgaggacgccgccaccuacuucugccagcaguacgacaaccugggcgaccugagcuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31868 - RNA, 690 nt, Artificial Sequence
  derived and/or modified sequence opt4 from anti-HIV_3MLZ_HeavyChain
caggugcagcugcaggagagcggccccggccuggugaagcccagcgagacccugagccugaccugcaccgugagcggcggcagcaucagcggcuuccacuggagcuggaucagacagccccccggcaagggccuggaguacaucggcuacaucuacuacagcggcagcaccagcuacaaccccagccugaagagcagagugagcaugagcguggacaccagcagaaaccaguucagccuggagcugagcagcgugaccgccgccgacaccgccguguacuacugcgccagagacuucggcgaguaccacuacgacggcagaggcuuccagugcgagggcuucgaccuguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 31869 - RNA, 642 nt, Artificial Sequence
  derived and/or modified sequence opt4 from anti-HIV_3MLZ_LightChain
cagagcgugcugacccagccccccagcgugagcgccgcccccggccagaaggugaccaucagcugcagcggcagcagcagcaacaucggcaacaacauggugagcugguaccagcagcaccccggcaccgcccccaagcugcugaucuacgagaacagcaagagacccagcggcauccccgacagauucagcggcagcagaagcggcaccagcgccacccugggcaucaucggccugcagaccggcgacgaggccgaguacuacugcgccaccugggacggcagccugagaaccguguucggcggcggcaccaagcugaccgugcugagccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugagagccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugc

SEQ ID NO: 31870 - RNA, 684 nt, Artificial Sequence
  derived and/or modified sequence opt4 from anti-HIV_3MLX_I-Chain
caggugcagcugcaggagagcggccccggccuggugaagcccagcgagacccugagccugaccugcaccgugagcggcggcagcaucagcggcuuccacuggagcuggaucagacagccccccggcaagggccuggaguacaucggcuacaucuacuacagcggcagcaccagcuacaaccccagccugaagagcagagugagcaugagcguggacaccagcagaaaccaguucagccuggagcugagcagcgugaccgccgccgacaccgccguguacuacugcgccagagacuucggcgaguaccacuacgacggcagaggcuuccagugcgagggcuucgaccuguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaag

SEQ ID NO: 31871 - RNA, 633 nt, Artificial Sequence
  derived and/or modified sequence opt4 from anti-HIV_3MLX_M-Chain
agcgugcugacccagccccccagcgugagcgccgcccccggccagaaggugaccaucagcugcagcggcagcagcagcaacaucggcaacaacauggugagcugguaccagcagcaccccggcaccgcccccaagcugcugaucuacgagaacagcaagagacccagcggcauccccgacagauucagcggcagcagaagcggcaccagcgccacccugggcaucaucggccugcagaccggcgacgaggccgaguacuacugcgccaccugggacggcagccugagaaccguguucggcggcggcaccaagcugaccgugcugagccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugagagccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccacc

SEQ ID NO: 31872 - RNA, 684 nt, Artificial Sequence
  derived and/or modified sequence opt4 from anti-HIV_3MLW_I-Chain
caggugcagcuggugcagagcggcgccgaggugaagaaggccggcgagagccuggagaucagcugcaagggcagcggcuacaccuucaccgaccacuggaucgccugggugagacaggugcccggcaagggccuggaguggaugggcaugaucuaccccggcgacagcgacaccagauacagccccagccugcagggcagagugaccaugagcgccgacaagacccugagcaccgccuaccugcaguggagcagacuggaggccagcgacaccgccauguacuacugcgccagacugcacuacagcgacagaagcggcagcuacuucaacgacguguuccacauguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagc

SEQ ID NO: 31873 - RNA, 645 nt, Artificial Sequence
  derived and/or modified sequence opt4 from anti-HIV_3MLW_M-Chain
cagagcgugcugacccagccccccagcgccagcggcacccccggccagagagugaccaucagcugcagcggcaacagcagcaacaucgagaacaacuacguguacugguaccagcagcugcccggcagcacccccaagcugcugaucuucagagacgaccagagacccagcggcgugcccgacagauucagcggcagcaagagcggcaccagcgccagccuggccaucagcggccugagaagcgaggacgaggccgacuacuacugcgccagcugggacgacagcagaggcggccccgacuacguguucggcaccggcaccaaggugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacggcagccccgugaaggccggcguggagaccaccaagcccagcaagcagagcaacaacaaguacgccgccagcagcuaccugagccugacccccgagcaguggaagagccacagaagcuacagcugccaggugacccacgagggcagcaccguggagaagaccguggcccccacc

SEQ ID NO: 31874 - RNA, 678 nt, Artificial Sequence
  derived and/or modified sequence opt4 from anti-HIV_3MLV_N-Chain
gaggugcagcugguggagagcggcggcgaggugaagcagcccggccagagccugaagaucagcugcaagagcagcggcuacaacuuccuggacagcuggaucggcugggugagacagauccccggcaagggccuggaguggaucggcaucaucuaccccgacgacagcgacgcccacuacagccccagcuucgagggccaggugaccaugagcguggacaagagcaucagcaccgccuaccugcaguggaccacccugcaggccagcgacaccggcaaguacuucugcaccagacuguaccuguucgagggcgcccagagcagcaacgccuucgaccuguggggccagggcaccaugauccuggugagcagcggcaccaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagc

SEQ ID NO: 31875 - RNA, 657 nt, Artificial Sequence
  derived and/or modified sequence opt4 from anti-HIV_3MLV_M-Chain
agcuaccugcugacccagccccccagcgugagcgugagccccggccagaccgccagcaucagcugcagcggcgacaagcuggacgacaaguacgugagcugguacuaccagagacccggccagagccccgugcugcugauguaccaggacuucaagagacccagcggcauccccgagagacugagcggcagcaagagcggcaagaccgccacccugaccaucagcggcacccagagccuggacgagggcgacuacuacugccaggccugggacgccagcaccggcgugagcggcggcggcaccaagcugaccgugcuguucggcgagggcaccagacugaccgugcuggcccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccacc

SEQ ID NO: 31876 - RNA, 654 nt, Artificial Sequence
  derived and/or modified sequence opt4 from anti-HIV_3MLU_LightChain
uaccugcugacccagccccccagcgugagcgugagccccggccagaccgccagcaucagcugcagcggcgacaagcuggacgacaaguacgugagcugguacuaccagagacccggccagagccccgugcugcugauguaccaggacuucaagagacccagcggcauccccgagagacugagcggcagcaagagcggcaagaccgccacccugaccaucagcggcacccagagccuggacgagggcgacuacuacugccaggccugggacgccagcaccggcgugagcggcggcggcaccaagcugaccgugcuguucggcgagggcaccagacugaccgugcuggcccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccacc

SEQ ID NO: 31877 - RNA, 657 nt, Artificial Sequence
  derived and/or modified sequence opt4 from anti-HIV_3MLT_G-Chain
agcuacgaccugacccagccccccagcgugagcgugagccccggccagaccgccagcaucagcugcagcggcgacaagcuggacgacaaguacgugagcugguacuaccagagacccggccagagccccgugcugcugauguaccaggacuucaagagacccagcggcauccccgagagacugagcggcagcaagagcggcaagaccgccacccugaccaucagcggcacccagagccuggacgagggcgacuacuacugccaggccugggacgccagcaccggcgugagcggcggcggcaccaagcugaccgugcuguucggcgacggcaccagacugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccacc

SEQ ID NO: 31878 - RNA, 666 nt, Artificial Sequence
  derived and/or modified sequence opt4 from anti-HIV_3GO1_HeavyChain
gaggugcagcugcaggagagcggccccggccuggugaagcccagcgagacccugagccugaccugcaccgugagcggcggccccaucaacaacgccuacuggaccuggaucagacagccccccggcaagggccuggaguaccugggcuacguguaccacaccggcgugaccaacuacaaccccagccugaagagcagacugaccaucaccaucgacaccagcagaaagcagcugagccugagccugaaguucgugaccgccgccgacagcgccguguacuacugcgccagagagugggccgaggacggcgacuucggcaacgccuuccacguguggggccagggcaccaugguggccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagccc

SEQ ID NO: 31879 - RNA, 627 nt, Artificial Sequence
  derived and/or modified sequence opt4 from anti-HIV_3GO1_LightChain
agcuacgugcugacccagccccccagcgugagcgugagccccggccagaccgccagaaucaccugcagcgccgaggcccugagcaaccaguacgccuacugguacagacagagacccggccaggccccccugcugaucaucuacaaggacaccaagagacccagcggcauccccgagagauucagcggcagcaccagcggcaccaccgugacccugaccaucagcggcgugcaggccgaggacgaggccgacuacuacugccagagcgccgacagcagcggcgacuacguguucggcggcggcaccaaggugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacggcagccccgugaaggccggcguggagaccaccaagcccagcaagcagagcaacaacaaguacgccgccagcagcuaccugagccugacccccgagcaguggaagagccacagaagcuacagcugccaggugacccacgagggcagcaccguggagaagaccguggccccc

SEQ ID NO: 31880 - RNA, 690 nt, Artificial Sequence
  derived and/or modified sequence opt4 from anti-HIV_4XCY_J-Chain
caggugcagcuggugcagagcggcgccgaggugaagagacccggcagcagcgugaccgugagcugcaaggccagcggcggcagcuucagcaccuacgcccugagcugggugagacaggcccccggcagaggccuggaguggaugggcggcgugaucccccugcugaccaucaccaacuacgcccccagauuccagggcagaaucaccaucaccgccgacagaagcaccagcaccgccuaccuggagcugaacagccugagacccgaggacaccgccguguacuacugcgccagagagggcaccaccggcuggggcuggcugggcaagcccaucggcgccuucgcccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 31881 - RNA, 645 nt, Artificial Sequence
  derived and/or modified sequence opt4 from anti-HIV_4XCY_K-Chain
gagaucgugcugacccagagccccggcacccagagccugagccccggcgagagagccacccugagcugcagagccagccagagcgugggcaacaacaagcuggccugguaccagcagagacccggccaggcccccagacugcugaucuacggcgccagcagcagacccagcggcguggccgacagauucagcggcagcggcagcggcaccgacuucacccugaccaucagcagacuggagcccgaggacuucgccguguacuacugccagcaguacggccagagccugagcaccuucggccagggcaccaagguggaggugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31882 - RNA, 630 nt, Artificial Sequence
  derived and/or modified sequence opt4 from anti-HIV_4YBL_C-Chain
gugcugacccagccccccagcgccagcggcagccccggccagagcgugaccaucagcugcaccggcaccagcagcgacgugggcggcuacaacuacgugagcugguaccagcaccaccccggcaaggcccccaagcugaucaucagcgaggugaacaacagacccagcggcgugcccgacagauucagcggcagcaagagcggcaacaccgccagccugaccgugagcggccugcaggccgaggacgaggccgaguacuacugcagcagcuacaccgacauccacaacuucguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggccccc

SEQ ID NO: 31883 - RNA, 672 nt, Artificial Sequence
  derived and/or modified sequence opt4 from anti-HIV_4YBL_B-Chain
caggugcagcugcaggagagcggccccggccuggugaagcccagccagacccugagccugagcugcaccgugagcggcggcagcagcagcagcggcgcccacuacuggagcuggaucagacaguaccccggcaagggccuggaguggaucggcuacauccacuacagcggcaacaccuacuacaaccccagccugaagagcagaaucaccaucagccagcacaccagcgagaaccaguucagccugaagcugaacagcgugaccguggccgacaccgccguguacuacugcgccagaggcaccagacugagaacccugagaaacgccuucgacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaag

SEQ ID NO: 31884 - RNA, 630 nt, Artificial Sequence
  derived and/or modified sequence opt4 from anti-HIV_4R4N_X-Chain
gacauccagaugacccagagccccagcuucgugagcgccagcgugggcgacagagugaccaucaccugcagagccagccagggcaucagcagcuaccuggccugguaccagcagaagcccggcaaggcccccaagcuggugaucuacgccgccagcacccugcagagcggcgugcccagcagauucagcggcagcggcagcggcaccgaguucacccugaccaucagcagccugcagcccgaggacuucgccaccuacuacugccagcaccugaucggccugagaagcuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacaga

SEQ ID NO: 31885 - RNA, 660 nt, Artificial Sequence
  derived and/or modified sequence opt4 from anti-HIV_4R4B_F-Chain
caggugcagcugcagcaguggggcgccggccugcugaagcccagcgagacccugagccugaccugcggcguguacggcgagagccugagcggccacuacuggagcugggugagacagccccccggcaagagacuggaguggaucggcgagaucaagcacaacggcagccccaacuaccaccccagccugaagagcagagugaccaucagccuggacaugagcaagaaccaguucagccugaaccugaccagcgugaccgccgccgacaccgccguguacuucugcgccagaagaagcaacuggcccuaccugcccuucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaag

SEQ ID NO: 31886 - RNA, 750 nt, Artificial Sequence
  derived and/or modified sequence opt4 from anti-HIV_3JUY_D-Chain
caggugcagcuggugcagagcggcgccgaggugaagaagcccggcgccagcgugaaggugagcugccaggccagcggcuacagauucagccacuucaccgugcacugggugagacaggcccccggccagagauucgaguggaugggcuggaucaaccccuacaacggcaacaaggaguucagcgccaaguuccaggacagagugaccuucaccgccgacaccagcgccaacaccgccuacauggagcugagaagccugagaagcgccgacaccgccguguacuacugcgccagagugggcgaguggggcugggacgacagccccuacgacaacuacuacauggacguguggggcaagggcaccaccgugaucgugagcagcggcggcggcggcagcggcggcggcggcagcggcggcggcggcagcgagaucgugcugacccaggcccccggcacccugagccugagccccggcgagagagccaccuucagcugcagaagcagccacagcaucagaagcagaagaguggccugguaccagcacaagcccggccaggcccccagacuggugauccacggcgugagcaacagagccagcggcaucagcgacagauucagcggcagcggcagcggcaccgacuucacccugaccaucaccagaguggagcccgaggacuucgcccuguacuacugccagguguacggcgccagcagcuacaccuucggccagggcaccaagcuggagagaaag

SEQ ID NO: 31887 - RNA, 369 nt, Artificial Sequence
  derived and/or modified sequence opt4 from anti-HIV_4KG5_HeavyChain
cagcuggugcagagcggccccgaggccaagagacccggcagcagcgugaaggugagcugcaaggccagcagagacaccuucaacaacuacgugcugaacugggugagacaggcccccggccagggccuggaguggaugggcggcaucggccccaucaucgagaccgccgacuacgccgagaaguucagaggcagacugagcaucaccgccgacgagagcaccaccaccgccuacauggagcugagcagccugaccagcgacgacaccgccguguacuacugcgccagaagccccuacagcagccugaccgacaccuacuacuacuacauggaccuguggggcaagggcaccaccgugaccgugagcagc

SEQ ID NO: 31888 - RNA, 336 nt, Artificial Sequence
  derived and/or modified sequence opt4 from anti-HIV_4KG5_LightChain
cugacccagagccccgacagccuggccgugagccugggcgagagagccaccaucaacugcaagagcagccagagcauccuggacagcagcaacaacagaaacuaccugaccugguaccagcagaagcccggccagccccccaagcugcugaucuacugggccagcaccagagagagcggcgugcccgacagauucagcggcagcggcagcagcaccgacuucacccugaccaucagcagccugcaggccgaggacguggccguguacuacugccagcaguacuucagcacccccggcaucaccuucggccagggcaccagacuggagaucaagaga

SEQ ID NO: 31889 - RNA, 309 nt, Artificial Sequence
  derived and/or modified sequence opt4 from anti-HIV-1_LightChain
gagaucgugcugacccagagccccgccacccugagccugagccccggcgagagagccacccugagcugcagagccagccagagcguguacaccaagcuggccugguaccagcagaagcccggccagccccccagacugcugaucuacgacgccagcaacagagccgccggcauccccgccagauucagcggcagcggcagcggcaccgaguucacccugaccaucaagagaauggagagagaggacuucgccguguacuacugccagauccuggaguucuucggccagggcaccaccaucgacaugaac

SEQ ID NO: 31890 - RNA, 312 nt, Artificial Sequence
  derived and/or modified sequence opt4 from anti-HIV-1_LightChain
gacauccagaugacccagagccccagcagcgugagcgccagcgugggcgacagagugaccaucaccugcagagccagccagggcauccugagcagccagcuggccuggcaccagcagagaagaggccagccccccagacugcugaucuacggcggcagcaacagagcccccggcauccccgagagauucaccggcagcggcagcggcaccgacuucgugcugaccaucaagagacugcagagagacgacuucgccguguacuacugccagauccuggaguucuucggcagaggcaccagaguggagaugaac

SEQ ID NO: 31891 - RNA, 312 nt, Artificial Sequence
  derived and/or modified sequence opt4 from anti-HIV-1_LightChain
ggccugcugcugacccagagccccggccccgugagcuucuuccccggcgagagagccaccgugagcugcagagccagccacagcgugaacagcgccgccaucaacugguaccagcagaagagaggccagccccccagacugaucaucguggacggcagcaccagagccaccgccgugcccgagagauucagcgccaccggcagcggcaccgaguucacccuggugaucagcagacuggagcccgaggacuucgccguguacuucugccagcaccugcaguucuucggccugggcaccaagguggacaucaag

SEQ ID NO: 31892 - RNA, 312 nt, Artificial Sequence
  derived and/or modified sequence opt4 from anti-HIV-1_LightChain
gccuucgugaugacccagagccccggcacccuggcccugagccccggcgagagagccacccugagcugcagaaccagccaggagauccugagcaaccagcuggccuggcaccagcagagaagaggccagccccccagacugcugaucuacggcggcagcaacagagcccccggcauccccgagagauucaccggcagcggcagcggcaccgacuucgugcugaccaucaacagacuggagagagacgacuucgccguguacuacugccagauccuggaguucuucggcagaggcaccagaguggagaugaac

SEQ ID NO: 31893 - RNA, 312 nt, Artificial Sequence
  derived and/or modified sequence opt4 from anti-HIV-1_LightChain
ggcaucgugcugacccagagccccgacacccugagccugagccccggcgacagagccacccugagcugcaagaccagccagagcaucgccagcgagcaccuggccugguaccagcagagacccggccagccccccagacugcugaucuucggcgccagcaacagagccagcggcauccccaccagauucagcggcagcggcagcggcgccgacuucacccugagcaucaccagacuggagcccgaggacuucgccguguacuacugccaguucagcgaguucuucggcagaggcgccagaguggaggugaag

SEQ ID NO: 31894 - RNA, 312 nt, Artificial Sequence
  derived and/or modified sequence opt4 from anti-HIV-1_LightChain
caguucgugaugacccagagccccgccacccugagcagcagccccggcggcaccgccacccugagcugcagaaccagccacagcauccugaacagccagcuggccuggcaccagcagagaagaggccagccccugagacugcugaucuacggcgccagcaacagagcccccggcauccccgagagauucagcgccagcggcagcggcaccgaguucgugcugaccaucaagagaauggagagagaggacuucgccguguacuacugccagauccuggaguucuucggccagggcaccaccaucgacaugaac

SEQ ID NO: 31895 - RNA, 354 nt, Artificial Sequence
  derived and/or modified sequence opt4 from anti-HIV-1_HeavyChain
agagugcaccuggugcagagcggcacccaggugaagaagcccggcgccagcgugaaggugagcugcgagaccagcggcuucaaguuccuggacagccugauccacugggugagacaggcccccggccagggccuguacuggaugggcuggaucaagcccuacagaggcagcgugaacuacgacggcuacuucagaggcagagugagcaugaccagagacaucuacaccgacaccgccuaccuggagcugagcggccugagaagcgacgacaccgccaucuacuacugcgccuucggcgccggcgacggcugggaccugguguggggccagggcacccuggugaucgugagcagc

SEQ ID NO: 31896 - RNA, 354 nt, Artificial Sequence
  derived and/or modified sequence opt4 from anti-HIV-1_HeavyChain
agagugcaccuggugcagagcggcacccaggugaagaagcccggcgccagcgugaaggugagcugcgagaccagcggcuucaaguuccuggacagccugauccacugggugagacaggcccccggccagggccuguacuggaugggcuggaucaagcccuucagaggcagcgugaacuacgacggcuacuucagaggcagagugagcaugaccagagacaucuacaccgacaccgccuacauggagcugagcggccugagaagcgacgacaccgccaucuacuacugcgccuucggcgccggcgacggcugggaccugguguggggccagggcacccuggugaucgugagcagc

SEQ ID NO: 31897 - RNA, 354 nt, Artificial Sequence
  derived and/or modified sequence opt4 from anti-HIV-1_HeavyChain
caggugcaccuggugcagagcggcacccaggugaagaagcccggcgccagcgugagagugagcugcgagaccagcggcuucaaguuccuggacagcaucauccacugguucagacaggcccccggcgagggccuguucuggaugggcuggaucaagcccuacaccggcagcgugaacuacgugagaagauaccagggcagagugagcaugaccagagacguguacagcgacaccgccuacauggaccugagcggccugaacagcgacgacaccgccguguacuucugcaccuacggcgccggcgacggcuggaaccugguguggggccagggcacccuggugaucgugagcgcc

SEQ ID NO: 31898 - RNA, 363 nt, Artificial Sequence
  derived and/or modified sequence opt4 from anti-HIV-1_HeavyChain
caggugagacuggugcagagcggcaaccaggugagaaagcccggcgccagcgugagaaucagcugcgaggccagcggcuacaaguucaucgaccacuucauccacugggugagacaggugcccggccacggccuggaguggcugggcuggaucaaccccagaggcggcggcgugaacuacagcagaggcuuccagggcaagcugagcaugaccaugaccagagacaacuucgaggagaccgccuaccuggaccugagcagacugaaccccggcgacaccgccguguacuacugcgccagaggcuucgccggcuacgaguggagcuuccuguggggccagggcacccuggugaucgugagcagc

SEQ ID NO: 31899 - RNA, 357 nt, Artificial Sequence
  derived and/or modified sequence opt4 from anti-HIV-1_HeavyChain
caggugagccuggugcagagcggcaaccagcugaagaagcccggcgccagcgugagaaucagcugcgagaccagcggcuacaacuuccugaaccacuucauccacugggugagacaggugcccggccacggccuggaguggcugggcuggaucaaccccagaggcggcggcgugaacuacagcagaaacuuccagggcaaggugagccugaccagaaacaucgacauggagaccguguaccuggacgugagaggccugacccccggcgacaccgccguguacuacugcgccagaggcuucggcggcagcgacuggaacuucguguggggccagggcaccagaaucaccgugagcgcc

SEQ ID NO: 31900 - RNA, 357 nt, Artificial Sequence
  derived and/or modified sequence opt4 from anti-HIV-1_HeavyChain
agaaucaaccugcaccagagcggcagccaggugaagagaagcggcgccagcgugagaaucagcugcgagaccagcggcuucaaguucauggacagccaccugcacugggugagacagguggccggccagggcuucgaguggaugggcuggaucuucaccagcggcggcggcgugaacuacgccagacaguuccagggcagacugacccugaccagagacguguucaccgacaccguguucauggaccugagcggcgugaacgugggcgacaccggcguguacuacugcgugaagggcaccggcggcaacgaguggggcuucagcuggggccagggcaccguggugguggugagcccc

SEQ ID NO: 31901 - RNA, 357 nt, Artificial Sequence
  derived and/or modified sequence opt4 from anti-HIV-1_HeavyChain
agaaucaaccuggaccagagcggcagccaggugaagaagagcggcgccagcgugagaaucagcugcgagaccagcggcuucaaguucauggacagccaccugcacugggugagacagguggccggccagcccuucgaguggaugggcuggaucuucaccagcggcggcggcgugaacuacgccagacaguuccagggcagacugacccugaccagagacguguucagcgagaccguguucauggaccugagcggccugaacgccggcgacaccggcguguacuucugcgugaagggcaccggcggcaacgaguggggcuucguguggggccagggcaccguggugguggugagcccc

SEQ ID NO: 31902 - RNA, 357 nt, Artificial Sequence
  derived and/or modified sequence opt4 from anti-HIV-1_HeavyChain
agaaucgagcugcaccagagcggcagccaggugaagaagagcggcgccagcgugagaaucagcugcgagaccagcggcuucaaguucauggacagccaccugcacugggugagacagguggccggccagagauucgaguggaugggcuggaucuucaccagcggcggcggcgugaacuacgccagacaguuccagggcagacugagacugaccagagacguguucagcgagagcguguucauggaccugagcggccugaacagcggcgacaccggcguguacuacugcgugaagggcaccggcggcaacgaguggggcuucguguggggccagggcagccuggugguggugagcccc

SEQ ID NO: 31903 - RNA, 372 nt, Artificial Sequence
  derived and/or modified sequence opt4 from anti-HIV-1_HeavyChain
caggcccuggugcagagcggcagccagaugaagaagcccggcgacagcgugagacugagcugccagaccagcgacagcgccaucaccaaguacuucauccacuggaucagacaggcccccggcaagggccuggaguggaucgccuggaucagccccuacggcggcagagugaacuacggcuggcaggugagagacagagccacccugaccagaaacauccacauggagaccguguacauggaccugagaggccugagacccgacgacaccgccaccuacuacugcgccaugagagacuacugcagagacgacaacugcaacagaugggaccugggccacuggggccagggcagccugaucguggugagcgcc

SEQ ID NO: 31904 - RNA, 357 nt, Artificial Sequence
  derived and/or modified sequence opt4 from anti-HIV-1_HeavyChain
caggugacccuggugcagagcggcaaccagcugaagagacccggcgccagcgugagaaucagcugcgagaccagcggcuacaacuucauggaccacuucauccacugggugagacaggugcccggccacggccccgaguggcugggcugggugaaccccagaggcggcggcgugaacuacagcagaaaguuccagggcagauucagcaugaccagagacguguacauggagaccgccuaccuggacgugaccggccugagccccgccgacaccgccguguacuacugcgccagaggcuucggcggcagcgacuggagcuuccuguggggccagggcacccugaucaucgugagcagc

SEQ ID NO: 31905 - RNA, 324 nt, Artificial Sequence
  derived and/or modified sequence opt4 from anti-HIV-1_LightChain
gagaucgugcugacccagagccccggcacccugagccugagcgccggcgagagagccagccugagcugcagagccagccagacccugaacagcaacuucuucgccugguaccaccagaagcccggccaggcccccagacugcugaucuacggcgccagcaacagagccaccggcauccccgacagauucagcggcagcggcagcggcagcgacuucacccugaccaucagcagacuggagcccgaggacuucggcaaguacuacugcgagcaguacgacgugagccccagaaccuucggccagggcaccaagguggagaucaag

SEQ ID NO: 31906 - RNA, 324 nt, Artificial Sequence
  derived and/or modified sequence opt4 from anti-HIV-1_LightChain
gagguggugcugacccagagccccggcacccugagccugagccccggcgagagagccacccugagcugcagagccagccagagcaucaacagcaacuucuucgccugguaccaccagaagcccggccaggcccccagacugcugaucuacggcgccagcagcagagccaccggcauccccgacagaaucagcggcaccggcagcggcgccgacuucacccugaccaucaccggccuggagcccgaggacuucggccuguacuacugccagcaguacgacuucagccccagaaccuucggccagggcaccagaguggagaucaag

SEQ ID NO: 31907 - RNA, 324 nt, Artificial Sequence
  derived and/or modified sequence opt4 from anti-HIV-1_LightChain
gagguggugcugacccagagccccggcacccugagccugagccccggcgagagagccacccugagcugcagagccagccagaccaucaacagcaacuucuucgccugguaccaccagaagcccggccaggcccccagacugcugaucuacggcgccagcagcagagccaccggcauccccgacagaaucagcggcagcggcagcggcaccgacuucacccugaccaucaccggccuggagcccgaggacuucggccuguacuacugccagcaguucgacuucagccccagaaccuucggccagggcaccagaguggagaucaag

SEQ ID NO: 31908 - RNA, 324 nt, Artificial Sequence
  derived and/or modified sequence opt4 from anti-HIV-1_LightChain
gagaucgugcugacccagagccccggcacccugagccuggcccccggcgagagagccacccugagcugcagagccagccagagcaucagcaccaccuaccuggccugguaccagcagaagcccggccaggcccccagacugcugaucuacgagaccagcagcagagccagcgacauccccgacagauucagcggcagcggcagcggcaccgacuucacccugaccaucagcagacuggagcccgaggacuucgccguguacuacugccaccaguacgacagaagccccagaaccuucggccagggcaccaagguggagaucaag

SEQ ID NO: 31909 - RNA, 336 nt, Artificial Sequence
  derived and/or modified sequence opt4 from anti-HIV-1_LightChain
gacaucgugaugacccagagccccgccagccugagcgugacccccggcgagaccgccagcaucagcugcaagugcagcagaagccugagagaggaggugggcuacaacuaccuggacugguaccugcagagacccggcaagagcccccagcugcugaucuacgugggcagcuucagagcccccggcgugagcgagagauucagaggcagcggcgagcacaaggacuucacccugaagaucgccagaguggagcccggcgacgccggcaucuacuacugcaugcagggcaucgacacccccagaaccuucggccagggcaccacccuggagaucaac

SEQ ID NO: 31910 - RNA, 321 nt, Artificial Sequence
  derived and/or modified sequence opt4 from anti-HIV-1_LightChain
gacauccagaugacccagagccccagcagccugagcgccagcgugggcgacagagugaccaucaccugcagagccagccaggccuucagaaacgaccugggcugguaccagcacaagcccggcaaggcccccgagagacugaucuacgccaccagcacccuggagagcggcgugcccagcagauucagcggcagcggcagcggcaccaacuucacccugaccaucagcagccugcaggccgaggacuucgccaccuacuacugccugcaguacaacaccuuccccagaaccuucggccagggcaccaagguggagaucaag

SEQ ID NO: 31911 - RNA, 333 nt, Artificial Sequence
  derived and/or modified sequence opt4 from anti-HIV-1_LightChain
aacuucaugcugacccagccccacagcgugagcgagagccccggcaagaccgugaccaucagcugcgccagaaccagaggcggcaucgacagcgccuacgugcacugguaccagcagagacccggcagcgugcccaccaccgugaucuucgaggacaacagaagaccccccggcgugcccgacagauucagcggcagcaucgacaccagcagcaacaccgccagccugaccaucagcggccugaagaccgaggacgaggccgacuacuacugccagagcuacgacgacaccuacuucuggguguucggcggcggcaccaagcugaccgugcug

SEQ ID NO: 31912 - RNA, 333 nt, Artificial Sequence
  derived and/or modified sequence opt4 from anti-HIV-1_LightChain
aacuucaugcugacccagccccacagcgugagcgagagccccggcaagaccgugaccaucagcugcgccagaaccagaggcaccaucgacagcgccuacgugcacugguaccagcagagacccggcgccgugcccaccaccgugaucuucgaggacgacagaagacccagcggcgugcccgacagauucagcggcagcaucgacagcagcagcaacagcgccagccugaccaucagcggccugaagaccgaggacgaggccgacuacuacugccagagcuacgacagcaacuacuacuggguguucggcggcggcaccaagcugaccgugcug

SEQ ID NO: 31913 - RNA, 396 nt, Artificial Sequence
  derived and/or modified sequence opt4 from anti-HIV-1_HeavyChain
caggugcagcugcagcagagcggccccgcccuggugaagcccagcgagacccugagccugaccugcagcgugagcagcggcagagugagcagcuacuacuggagcuggaucagacagagccccggcaagggccuggaguggaucggcuacauccacuacgaccccgacaccaacaccaacuacagaacccacuaccaccccagccugagaggcagaguggugaucagcguggacagcagcaagagccaggugagccugaaggugagaagcgugaccgccgccgacagcgcccuguacuacugcgccagacacagauacgaccccuggagcaagggcuacgacaucagaagccccuucgacuucuggggccagggcacccuggugaccgugagcagc

SEQ ID NO: 31914 - RNA, 396 nt, Artificial Sequence
  derived and/or modified sequence opt4 from anti-HIV-1_HeavyChain
caggugcaccugcagcagagcggccccggccuggugaagcccagcgagacccugagccugaccugcaccgugagcggcggcagagugagcagcuacuacuggagcuggaucagacagagccccggcaagggccuggaguggaucggcuacauccacuacgaccccgacaccagcaccaacuacagaacccacuaccaccccagccugagaggcagaguggugaucagcguggacaccagcaagaaccaggugagccugaccgugagaagcgugaccgccgccgacagcgcccuguacuacugcgccagacacagauacgacguguggagcaacggcuacgacaucagaagccccuacgacuucuggggcagaggcacccuggugaccgugagcagc

SEQ ID NO: 31915 - RNA, 396 nt, Artificial Sequence
  derived and/or modified sequence opt4 from anti-HIV-1_HeavyChain
caggugcaccuggagcagagcggccccgcccuggugaagcccagcgagacccugagccugaccugcaccgugagcggcggcagagugagcagcuacuacuggagcuggaucagacagagccccggcaagggccuggaguggaucggcuacauccacuacgaccccgacaccagcaccaacuacagaacccacuaccaccccagccugagaggcagaguggugaucagcguggacagcagcaagaaccaggugagccugaaggugagaagcgugaccgccgccgacagcgcccuguacuacugcgccagacacagauacgacguguggagcaagggcuacgacaucagaagccccuucgacuucuggggcagaggcacccuggugaccgugagcagc

SEQ ID NO: 31916 - RNA, 390 nt, Artificial Sequence
  derived and/or modified sequence opt4 from anti-HIV-1_HeavyChain
caggugguguuccagaagcccggccccggcguggugaagcccagcgagacccugagccugaccugcaccgugagcggcggcagagugagaagcuacuacuggagcuggaucagacugccccccggccagggccuggaguggaucggcuacauccacuacgacgagaccaccgaguacaagagaagcuacaaccccagccugaagagcagaaucaccaucagcauggacaccagcaagaaccaggugagccugaagcugagcagcgugaccgccgccgacgccgccguguacuacugcgccagacacagauacgacagauggagcgacagcuacgacaucagaagccccuucgacaucuggggccagggcaccguggugaccgugagcgcc

SEQ ID NO: 31917 - RNA, 396 nt, Artificial Sequence
  derived and/or modified sequence opt4 from anti-HIV-1_HeavyChain
caggugcagcugcagcaguggggcgccggccugcugaagcccagcgagacccugagccugaccugcgccaucuacggcagcagcuucagcggccacuacuggauguggaucagacagagccccgccaagacccuggaguggaucgccgagaucaaccacaccggcggcaccagauacaaccccagccuggccagcagagugagaguguucagcgacaccagcaagaaccaguucagccugaacaugaccagccugaccgccgccgacaccggcaucuacuacugcgugagaggccaccugagcagagacagacugggccaguacgccuucuggagcggcgcccugaucgacuaccuggaccccuggggccagggcacccuggugaccgugagcagc

SEQ ID NO: 31918 - RNA, 387 nt, Artificial Sequence
  derived and/or modified sequence opt4 from anti-HIV-1_HeavyChain
caggugcagcugcaccaguggggcgccggccugcugaagcccagcgagacccugagccugaccugcgccguguacggcagcuucaccggcuuccaguggaccugggugagacagacccccggcaagggccuggaguggaucggcgagaucaaccacagcggccugcuggugaccggcaagaccgacuacaaccccagccuggagagcagagugaccaucagcguggacaccagcaagaaccaguucagccugaagcugaccagcgugaccgccgccgacaccggcguguacuacugcgccagagccggcggcaugagcgacugggccuaccccuacuacuacggcauggacguguggggccagggcaccauggugaccgugagcagc

SEQ ID NO: 31919 - RNA, 357 nt, Artificial Sequence
  derived and/or modified sequence opt4 from anti-HIV-1_HeavyChain
caggugcagcugguggagagcggcggcggcguggugcagcccggcagaagccugacccugagcugcgccaccagcggcuucgacuucagcagcuacggcuuccacugggugagacaggcccccggcaagggccugcagugggugagcaucaucagccacgacggcagcaucaagaacuacggcgacagcaugaagggcagauucagcgugagcagagacaacgccaaggacauccuguaccugcagaugaacagccugagacccgacgacaccgcccuguaccacugcgugagaggcgacggcgagaacggcggcaccgacuacuggggccugggcacccuggugaccgugagcgcc

SEQ ID NO: 31920 - RNA, 357 nt, Artificial Sequence
  derived and/or modified sequence opt4 from anti-HIV-1_HeavyChain
cagguggaccugguggagagcggcggcggcguggugcagcccggcaagagccugaagcugagcugcaccgccagcggcuucaccuucaccagcuacggcaugcacugggugagacagauccccggcaagggccuggaguggguggccaucaucagccacgacggcaccaucaagaacuacggcgacagcgugaagggcagauucaccaucagcagagacaacgccaugaacauccuguaccugcagaugaacaaccugagaggcgacgacaccgcccuguacuacugcgugagaggcgacggcgagaacggcggcaccgacuacuggggccagggcaccguggugaccgugagcagc

SEQ ID NO: 31921 - RNA, 369 nt, Artificial Sequence
  derived and/or modified sequence opt4 from anti-HIV_V3_HeavyChain
gaggugcagcuggugcagagcggcgccgaggugaagaagcccggcgagagccugaagaucagcugccagggcuucggcuacaccuucagcaccuacuggaucggcugggugagacagaugcccggcaagggccuggaguggcugggcaucaucuaccccgaggacagcgagaccaucuacagccccagcuuccagggccaggccaccaucagcgccgacaagagccugagcaccgccuaccugcaguggagcggccugagagccagcgacagcgccaucuacuacugcgccagacugggcuacugcggcagcaccagcugcagcuucuucgacuucuggggcagaggcacccuggugaccgugagcagc

SEQ ID NO: 31922 - RNA, 369 nt, Artificial Sequence
  derived and/or modified sequence opt4 from anti-HIV_V3_HeavyChain
gaggugcagcuggugcagagcggcgccgaggugaccaagcccggcgagagccugaagaucagcugcaagggcagcggcuacagcuucagcacccacuggaucgccugggugagacagaugcccggcagaggccuggaguggaugggcuucaucuaccccgacgacagcgacaccagauacagccccagccugcagggccacgugaucaucagcgccgacaagagccugagcaccgccuaccugcaguggagcagccugaaggccagcgacaccgccauguacuacugcgccagacugggcggcgacgaguaccagagcagcggcggcauggacguguggggccagggcaccaccgugaucgugagcagc

SEQ ID NO: 31923 - RNA, 393 nt, Artificial Sequence
  derived and/or modified sequence opt4 from anti-HIV_V3_HeavyChain
gaggugcagcuggugcagagcggcgccgaggugaagaagcccggcgccaccgugaagaucagcugcaaggugagcggcuacacccugaccgacuacuacauccacugggugcagcaggcccccggcagaggccuggaguggcugggccugguggaccccgagaacggcgagacccuguacgccgagaaguuccagggcagagugacccugaccgccgacaccagcaccgacaccgccuacauggagcugaagagccugagauacgaggacaccgccguguacuacugcgccaccgagggcccccccagcuacuacgacagcggcaccuacgccaagagccugcccgccagcuucgccugcuggggccagggcacccuggugaccgugagcagc

SEQ ID NO: 31924 - RNA, 369 nt, Artificial Sequence
  derived and/or modified sequence opt4 from anti-HIV_V3_HeavyChain
caggugcagcugcaggagagcggccccggccuggugaagcccagcgagacccugagccugaccugcaccgugagcggcggcagcaucaacaacuacuacuggagcuggaucagacagccccccggcaagggccuggaguacaucggcuacaucuucuacagcggcagcaccaacuacaaccccagccugaagagcagagugaccuucagcguggacaccagcaagaaccaguucagccugaagcugaccagcgugaccgccaccgacaccgccguguacuacugcgccagaggcccccugcuguacuucggcgcccccagaacccacuucgacuacuggggccagggcgcccuggugaccgugagcagc

SEQ ID NO: 31925 - RNA, 372 nt, Artificial Sequence
  derived and/or modified sequence opt4 from anti-HIV_V3_HeavyChain
gaggugcagcuggugcagagcggcgccgaggugaagaagcccggcgagagccugaagaucagcugcaagggcagcggcuacagcuucagcagccacuggaucggcugggugagacagcugcccggcaagggccuggaguggaugggcaucaucuaccccgacgacagcgacaccaaguacaaccccagcuuccagggccaggugaccaucagcgccgacagaagcaucagcaccgccuaccugcaguggagcagccugaaggccagcgacaccgccauguacuacugcgccagagugggcuacgacagcuacggcuacagcggcagcaacuucgacgaguggggccagggcacccuggugaccgugagcagc

SEQ ID NO: 31926 - RNA, 357 nt, Artificial Sequence
  derived and/or modified sequence opt4 from anti-HIV_V3_HeavyChain
gaggugcagcuggugcagagcggcgccgaggugaagaagcccggcgagagccugaagaucagcugcaagggcagcggcuacaacuucaacagcgacuggaucggcugggugagacagaugcccggcaagggccuggagugggugggcaugaucuaccccgacgacuucgaggugagacacagcccccccuuccagggcagagugaccaugagcguggacaagagcaucagcaccgccuaccugcaguggagcagccugaagagcagcgacaccggcauguacuucugcgccagacuggacggcaacgccgccgccuucgacuacuggggccagggcacccaggugaccgugagcagc

SEQ ID NO: 31927 - RNA, 360 nt, Artificial Sequence
  derived and/or modified sequence opt4 from anti-HIV_V3_HeavyChain
gacgugcagcuggugcagagcggcgccgaggugaagaaggccggcgagagccugaagaucagcugcagacccagcggcuacaacuucgccgacuacuggaucggcugggugagacagaugcccggcaagggccuggaguggaugggcaucaucuuccccgacgacagcgacaccagauacggccccagcuucgagggccaggugaccaucagcgccgacaagagcaucaacaccgccuaccugcaguggaacagccugaaggccagcgacaccgccauguacuucugcgccagacacggcggcagcggcgccgcccccggcgacuacuggggccagggcacccuggugaccgugagcagc

SEQ ID NO: 31928 - RNA, 363 nt, Artificial Sequence
  derived and/or modified sequence opt4 from anti-HIV_V3_HeavyChain
gaggugcagcuggugcagagcggcgccgaggugaagaagcccggcgccaccgugaagaucagcugcaaggugagcggcuacaccuucaccgacuacuucaugcacugggugcaggaggcccccggcaagggccuggccuggaugggccugguggaccccgagaacggcgacaccguguacgccgagaagcugcagggcagagugaccaugagcgccgacaccagcagagacaccgccuacauggagcugaccagccugagaagcgaggacaccgccguguacuacugcgccaucggcaagagcguggccggcaccagcgccuacgacaucuggggccagggcaccauggugaccgugagcagc

SEQ ID NO: 31929 - RNA, 369 nt, Artificial Sequence
  derived and/or modified sequence opt4 from anti-HIV_V3_HeavyChain
caggugcagcuggugcagagcggcgccgaggugagaaagcccggcgccagcgugaaggugagcugcaaggccagcggcgacaccuucaacaaccacgacaucaacugggugagacaggcccccggccagggccccgagugggugggcuggaugaaccccaagagcggcaacgccggcuacgcccagaaguuccagggcagagugaccaugaccagagacaccagcaucagcaccgccuacauggagcugagaagccugaccagcgaggacaccggcguguacuacugcgccagacugaccguggacugcgacgacggcggcugcuacggcgacuacuggggccagggcacccuggugaccgugagcagc

SEQ ID NO: 31930 - RNA, 354 nt, Artificial Sequence
  derived and/or modified sequence opt4 from anti-HIV_V3_HeavyChain
gagguguaccugcagcagagcggcgccgagcugaaggagcccggcgccaacgugaagaucagcugcaaggccuucggcuucaucuucaccgacuacuucauccacuggcugagacaggcccccggcaagggcccccagugggugggcgugguggaccccgaggacggcagcaccaccuacgccgaggccuuccagggcagagugagcaucaccgccgacagaagcaccgacaccgccuacauggaccuggccggccugaccagcgacgacaccgccguguacuacugcgcccugauguggaacgagagcggccccgacaacuggggccagggcacccuggugaucgugagcagc

SEQ ID NO: 31931 - RNA, 393 nt, Artificial Sequence
  derived and/or modified sequence opt4 from anti-HIV_V3_HeavyChain
gaggugcaggugguggaguucggcggcgaggugaagaagcccggcgccagcgugaaggugagcugcgaggccagcggcuacaccuucgccaaguucgccauccacugggugagacaggcccccagacagggccuggaguggaugggcuggaucaacggcgacgacggcaagaccgaguacagccagaaguuccaggacagagugaccaugaccagagacaccagcgccagcaccguguacauggagcugagcagccugagaagcgaggacaccgcccuguacuacugcgccagagccauguaccccgacaccgugaccggcaacgacaaccccgcccccccccccuucgagggcgacuacuggggccagggcacccuggugaccgugagcagc

SEQ ID NO: 31932 - RNA, 393 nt, Artificial Sequence
  derived and/or modified sequence opt4 from anti-HIV_V3_HeavyChain
gaggugcagcugguggagagcggcggcggccuggugaagcccggcggcagccugagacugaccugcguggccagcggcuucaccuucagcgacguguggcugaacugggugagacaggcccccggcaagggccuggagugggugggcagaaucaagagcagaaccgacggcggcaccaccgacuacgccgccagcgugaagggcagauucaccaucagcagagacgacagcaagaacacccuguaccugcagaugaacagccugaagaccgaggacaccgccguguacagcugcaccaccgacggcuucaucaugaucagaggcgugagcgaggacuacuacuacuacuacauggacguguggggcaagggcaccaccgugaccgugagcagc

SEQ ID NO: 31933 - RNA, 387 nt, Artificial Sequence
  derived and/or modified sequence opt4 from anti-HIV_CD4bs_HeavyChain
gaggagcagcugguggagagcggcggcggccuggugaagcccggcggcagccagagacugagcugcgccgccagcgaguucaccuucagcagauacaccaugaacugggugagacaggcccccggcaagggccuggagugggugagcagcaucagcggcaacgacaacaacaucuacuacgccgacagcgugaagggcagauucaccaucagcagagacaacgccagaaacagccuguaccugcagaucaacagccugagaguggaggacaccgccguguacuacugcgccagaggcccccuggacagcuacgacuucuggagcggcagcagacacuacuacggccuggacguguggggccagggcaccaccgugaccgugagcagc

SEQ ID NO: 31934 - RNA, 372 nt, Artificial Sequence
  derived and/or modified sequence opt4 from anti-HIV_CD4bs_HeavyChain
caggugcagcuggugcagagcggcagcgagcugaagaagcccggcgccagcgugaaggugagcugcaaggccagcggcuacaccuucaccagccacaucaucaacugggugagacaggcccccggccagggccuggaguggaugggcuggaucaacaccaacaccggcaaccccaccuacgcccagggcuucaccggcagauucguguucagccuggacaccagcgugagcauggccuaccugcagaucagcagccugaaggccgaggacaccggcguguacuacugcgccagaggcuucagacaguggcugguggccagaaucaccuacuucgacuacuggggccagggcacccuggugaccgugagcagc

SEQ ID NO: 31935 - RNA, 369 nt, Artificial Sequence
  derived and/or modified sequence opt4 from anti-HIV_CD4bs_HeavyChain
gagcugagacugcaggccagcggccccggccuggugaagcccagcgagacccugagccuggugugcagcgugagcggcgugagcaucagcgacagcuacuggaacuggaucagacagcccgccggcaagggccuggaguggaucggcagaguguacaccagaggcacccacaccuacaaccccagccugggcggcagagccaccgugagcggcgacaccaacaagaacgaggugagccugaagcugaugagcgugaccgccgccgacaccgccguguacuacugcgccagagcccugagcggcgacuggaccagaagauacuucuacauggacguguggggcagaggcacccccgugaccgugagcagc

SEQ ID NO: 31936 - RNA, 381 nt, Artificial Sequence
  derived and/or modified sequence opt4 from anti-HIV_CD4bs_HeavyChain
cagcugcagcugcaggagagcggccccagacuggugaagcccagcgagacccugagccugaccugcaccgugagcggcggcagcaucagcagcggcgacuacuacuggaccuggaucagacagccccccggcgagggccuggaguacaucggcuacaucuacagcggcggcagcaccgacuacaaccccagccugaagagcagagccagcaucagccaggacaccagcaccaacgaguucagccugaagcugaccagcgugaccgccgccgacaccgccguguacuucugcgccagagacagaagagugcugcugugguucggcgagcccagaagaggccuggacuucuggggccccggcacccuggugaccgugagcagc

SEQ ID NO: 31937 - RNA, 396 nt, Artificial Sequence
  derived and/or modified sequence opt4 from anti-HIV_CD4bs_HeavyChain
gaggugcagcugguggagagcggcggcggccuggugaagcccggcggcagccugagacugagcugcgccgccagcggcuucaccuucagcagcgccuggaugagcugggugagacaggcccccggcaagggccuggagugggugggcagaaucaagagcaagagcgacggcgagaccaccgacuacgccgcccccgugaagggcagauucaccaucagcagagacaaccuggagagcacccuguaccugcagcugaacagccugaagaccgaggacaccgccguguacuacugcgccaccgccacccccagcuacuacgacaucaugaccggcaacuacaaguacuacuacuacauggacguguggggcaagggcaccaccgugaccgugagcagc

SEQ ID NO: 31938 - RNA, 363 nt, Artificial Sequence
  derived and/or modified sequence opt4 from anti-HIV_CD4bs_HeavyChain
caggugcagcugguggagagcggcggcggccuggugaagcccggcggcagccugagacugagcugcgccgccagcggcuucaucuucagagaccacuacaugaccuggaucagacaggcccccggcaagggccuggagugggugagcuacaucagcagcagcagcaacaacauccaguacgccgacagcgugaagggcagauucaccgugagcagagacaacgccaagaacagccuguaccugcagaugaacagccugagagccgacgacaccgccguguacuacugcgccagaagcggccccuucuacaacuacggcccccccaacaacuggggccagggcacccuggugaccgugagcagc

SEQ ID NO: 31939 - RNA, 378 nt, Artificial Sequence
  derived and/or modified sequence opt4 from anti-HIV_CD4bs_HeavyChain
caggugcagcugguggagagcggcggcggcguggugcagcccggcggcagccugacccugagcugcaccgccagcggcuuccccuucaacagcuacgccaugcacugggugagacaggcccccggcaagggccuggagugggugagcaugaccagccacgacggcggcaacaaggacuucguggacagcgugaagggcagauucaccaucagcagagacaacagcagaaacacccuguuccugcagaugaacagccugagccaggacgacaccggcguguacuacugcgugagaggcaagcuggaggacuacaacuucuggggccacuacagagacuucgacagcuggggccagggcacccuggugaccgugagcgcc

SEQ ID NO: 31940 - RNA, 405 nt, Artificial Sequence
  derived and/or modified sequence opt4 from anti-HIV_CD4bs_HeavyChain
gagccccacgugguggagagcggcggcggcauggccaagcccggcggcagccugagacugagcugcgccggcagcggcuucaccuucaccaacgccuggaugaacugggugagacaggcccccggcaagggccuggagugggugggccugaucaagagcaagagcgacggcggcaccaccgacuacgccgccgacguggagggcagauucaccaucagcagagacgaccuggagagcaccauguuccuggagaugcacagccugcagaucgaggacaccgccguguacuucugcaccacccaguaccccagauacuacgaccugaugaccggcaacuacaagagaagauacuucagcagcggcauggacguguggggccagggcaccgccgugaccgugagcagc

SEQ ID NO: 31941 - RNA, 384 nt, Artificial Sequence
  derived and/or modified sequence opt4 from anti-HIV_CD4bs_HeavyChain
caggugcagcugcaggagagcggccccggccuggugaagcccagccagacccugagccugaccugcaccgugagcggcgacagcgugagcagcggcaacuacuacuggagcuggaucagacagcccgccggcaagccccuggaguggaucggccacaucagcaccggcggcggcaccaagaacaaccccagccugcagagcagagugaccaucagccuggacagcagcaagaaccaggugagccugagccugagcagcgugaccgccgccgacaccgccguguacaccugcgccagaggcccccccagaagccugugguucggcgaccccaccuacagcuacauggacguguggggcaagggcaccaccgugaccgugagcagc

SEQ ID NO: 31942 - RNA, 372 nt, Artificial Sequence
  derived and/or modified sequence opt4 from anti-HIV_CD4bs_HeavyChain
caggugcagcuggugcagagcggcgccgaggugaagaagcccggcagcagcgugaaggugagcugcaaggccagcggcggcaccuucaacagccacgccuucaccugggugagacaggcccccggccagggccuggaguggaugggcggcaucauccccacccugggccuggccaacgacgcccagaaguuccagggcagauucaccaucaccgccgacgagagcaccaccaccguguacauggagcugagcagccugagaagcgaggacaccgccguguacuacugcgccagaagacccuacuacgaccaggugagcggcgugggcgccuucgacaucuggggccagggcaccagagugaccgugagcagc

SEQ ID NO: 31943 - RNA, 390 nt, Artificial Sequence
  derived and/or modified sequence opt4 from anti-HIV_V2_HeavyChain
caggugcagcuggugcagagcggcgccgaggugaagaagcccggcagcagcgugaaggugagcugcgaggccagcggcgugaccagcagcagcuacaccaucagcugggugagacuggcccccggccagggccuggaguggaugggcagaaucacccccaucuucgacaucaccaacuacgcccagaaguuccagggcagagugacccugaccgccgacaagagcaccggcaccaccuacauggagcugagcagccugagaagcgacgacaccgccguguacuacugcgccagagacaagagcgacguggugguggugaccagcaucagacccgccuacuacuacggcauggacguguggggccagggcaccaccgugaccgugagcagc

SEQ ID NO: 31944 - RNA, 366 nt, Artificial Sequence
  derived and/or modified sequence opt4 from anti-HIV_V2_HeavyChain
caggugcagcuggugcagagcggcgccgaggugaagaagcccggcagcagcgugaaggugagcugcaaggccagcggcggcaccuucagaagcuacgccaucagcugggugagacaggcccccggccagggccuggaguggaugggcggcaucauccccaucuucggcaccgccgacuacgcccagaaguuccagggcaaggugaccaucaccgccgacgagagcaccagcaccgccuacauggagcugagcagccugaccagcgaggacaccgccauguacuacugcgccagaagcagagaccacuucuucgacaccagaguguuccagggcuggggccagggcacccuggugaccgugagcagc

SEQ ID NO: 31945 - RNA, 363 nt, Artificial Sequence
  derived and/or modified sequence opt4 from anti-HIV_V2_HeavyChain
caggugcagcuggugcagagcggcgccgaggugaagaagcccggcagcagcgugaaggugagcugcaaggccagcggcggcaacuucaacaccuacaccaucagcugggugagacaggcccccggccagggccuggaguggaugggcagaaucauccccaucuucggcaucgugaaccccgcccagaaguuccccggcagagugaccaucaacguggacaagagcaccaacaccgccuacauggagcugagcagccugagaagcgaggacaccgccguguacuacugcgccaccagcggcgugggccugcacuucggcuacuucgacuacuggggccagggcacccaggugaccgugagcagc

SEQ ID NO: 31946 - RNA, 378 nt, Artificial Sequence
  derived and/or modified sequence opt4 from anti-HIV_V2_HeavyChain
caggugcagcugcagcaguggggccccggccugcugaagcccagcgagacccugagccugaccugcgccguguacggcggcagcuucggcagauacuacuggagcuggaucagacagagcagcggcgagggccuggaguggcugggccagaucgaccacaccggcagcaccaccuacaaccccagccugaagggcagagugaccaucagcaucgacagcagcaccaaccaguucagccugaaggugaccagcgugaucgccgccgacaccgccguguacuacugcgccagagcccccagcggcuaccccggcgugagccuguaccaguacuacggccuggacguguggggccagggcaccaccgugaccgugagcccc

SEQ ID NO: 31947 - RNA, 366 nt, Artificial Sequence
  derived and/or modified sequence opt4 from anti-HIV_V2_HeavyChain
caggugcagcuggugcagagcggcgccgaggugaagaagcccggcagcagcgugaaggugagcugcaaggccagcggcggcaccuucagcaacuacgccaucagcugggugagacaggcccccggccagggccuggaguggaugggcggcaucauccccaucuucggcaccaccgacuacgcccagaaguuccagggcagagugaccaucaccgccgacgccagcaccagcaccgccuacauggagcugagcagccugagaagcgacgacaccgccguguacuacugcgccagaagcagaggccacuacuucgacaccagaguguucgagggcuggggccagggcacccuggugaccgugagcagc

SEQ ID NO: 31948 - RNA, 372 nt, Artificial Sequence
  derived and/or modified sequence opt4 from anti-HIV_V2_HeavyChain
caggugcaccuggugcagagcggcaccgaggugaagaagcccggcgccagcgugaccgugagcugcaaggccagcggcuacagcuucaccggcuacuaccugcacugggugagacaggcccccggccagggccuggaguggaugggcuggaucaaccccaacagcggcggcaccuacuacgcccagaacuuccaggccagagugaccaugaccagagacaccagcaucagcaccguguacauggaccugagcagacugagaagcgacgacaccgccguguacuacugcgugagaagagccgugcugaccgcccugccccccagauacuacuucgacuucuggggccagggcacccuggugaccgugagcagc

SEQ ID NO: 31949 - RNA, 318 nt, Artificial Sequence
  derived and/or modified sequence opt4 from anti-HIV_V3_LightChain
agccuggagcugacccagccccccagcgugagcgugagccccggccagaccgugagcaucaccugcagcggcaaccugcugggcgacaaggacgccagcugguaccagcugaagcccggccagagccccauccuggugaucuaccuggacaccgagagacccagcggcauccccgagagauucagcggcagcaagagcggcaacaccgccacccugaccaucagcggcacccaggccauggacgaggccgaguacuucugccaggccugggacaccaccaccgugcuguucggcggcggcaccagacugaccgugcug

SEQ ID NO: 31950 - RNA, 324 nt, Artificial Sequence
  derived and/or modified sequence opt4 from anti-HIV_V3_LightChain
agcgacgagcugacccagccccccagcgugagcgugagccccggccagaccgccagaaucaccugcagcggcgacgcccugcccgagaaguacgccuacugguaccagcagaagagcggccaggcccccgugcuggugaucgacgaggacaacaagagacccuucggcacccccgagagauucagcggcagcagaagcggcaccauggccacccugaccaucaccggcgcccagauggaggacgaggccgacuacuacugcagcagcaccgacagcagaggcaccuacuggguguucggcggcggcaccaagcugaccgugcug

SEQ ID NO: 31951 - RNA, 336 nt, Artificial Sequence
  derived and/or modified sequence opt4 from anti-HIV_V3_LightChain
cagagcgugcugacccagccccccagcgugagcgccgcccccggccagaaggugaccaucagcugcagcgccggcaacagcaagaucggcgacaacuacaucagcugguaccagcacgugcccggcgccgcccccaagcugcugaucuacgagaacgacaagagacccagcggcauccccgacagauucagcggcagcaagagcggcaccagcgccagccugggcaucaccggccugcagaccggcgacgaggccgacuacuacugcgccgccugggacaacagccugagcagcgcccuguacguguucggcaccggcaccaaggugaccgugcug

SEQ ID NO: 31952 - RNA, 339 nt, Artificial Sequence
  derived and/or modified sequence opt4 from anti-HIV_V3_LightChain
gacaucgugaugacccagagccccgacagccuggccgugagccugggcgagagagccaccaucaacugcaagagcagccagaacguguucuacagcagcaacaacagaaacuaccuggccugguaccagcagagacccggccagccccccaagcugcuguucuacugggccagcaccagagagagcggcgugcccgacagauucagcggcagcggcagcggcaccgacuucacccugaccaucagcagccugcagaccgaggacguggccaucuacuacugccagcaguacuacaacaccccccccaccuucggccccggcaccaagguggagaucaag

SEQ ID NO: 31953 - RNA, 318 nt, Artificial Sequence
  derived and/or modified sequence opt4 from anti-HIV_V3_LightChain
agcuacgagcugacccagccccccagcgugagcgugagccccggccagaccgccaccaucaccugcagcggcgaccugcugggcgacaaguacgccagcugguacagacagaagcccggccagagccccgugcuggugaucuacgaggacaccaagagacccagcggccugcccgagagauucagcggcagcaacagcggcaacaccgccacccugaccaucagcgagacccaggccauggacgaggccgacuacuacugccaggccugggacaccagaaccgugguguucggcggcggcaccaagcugaccgugcug

SEQ ID NO: 31954 - RNA, 327 nt, Artificial Sequence
  derived and/or modified sequence opt4 from anti-HIV_V3_LightChain
cagagcgugcugacccagccccccagcgugagcgccgcccccggccagaaggugaccaucagcugcagcggcagaagcagcgacaucgagaacaaguucgugagcugguaccagcagcugcccggcaccgcccccaagcugcugaucuacgaggacaacaagagacccagcggcauccccgacagauucagcggcagcaagagcggcaccagcgccacccugggcaucaccggccugcagaccggcgacgaggccgacuacuacugcggcaccugggacaacaaccugagagccggcuucggcggcggcacccaccugaccgugcug

SEQ ID NO: 31955 - RNA, 324 nt, Artificial Sequence
  derived and/or modified sequence opt4 from anti-HIV_V3_LightChain
agcuacgagcugacccagccccccagcgugagcgugagccccggccagaccgccagaaucaccugcagcggcgacgcccugcccaacaaguacgccuucugguaccagcagaagagcggccaggcccccgugcuggugaucuucgacgacaacagaagacccgccggcauccccgagagauucagcggcagcagaagcggcacccuggccacccugaccaucagcggcgcccagguggaggacgaggccgacuacuacugcuacagcaccgacaacgacggcaaguacuucguguucggcagcggcaccauggugaccgugcug

SEQ ID NO: 31956 - RNA, 318 nt, Artificial Sequence
  derived and/or modified sequence opt4 from anti-HIV_V3_LightChain
agcuacgagcugacccagccccccagcgugagcgugagccccggccagaccgccagcaucaccugcagcggccacaagcugggcgacaaguacgccagcugguaccagcacaagcccggccagagccccgugcuggugaucuacgaggacacccagagacccagcggcauccccgagagaaucagcggcagcaagagcggcaacaccgccacccugaccaucagcggcacccaggccauggacgaggccgacuacuacugccaggccugggacagcagagccgccguguucggcggcggcaccagacugaccgugcug

SEQ ID NO: 31957 - RNA, 327 nt, Artificial Sequence
  derived and/or modified sequence opt4 from anti-HIV_V3_LightChain
cagagcgcccugacccagcccgccagcgugagcggcagccccggccagagcaucaccaucagcugcaccggcaucagcagcgacaucggcaccgacaacuacgugagcugguaccagcagcaccccggcaaggcccccaagcugaucaucuacgaggugagcaacagacccagcggcaucagccacagauucagcggcagcaagagcggcaacaccgccagccugaucaucagcggccugcagguggaggacgaggcccacuacuacugcaacagcuacagaagcgacacccugguguucggcggcggcaccaaggugaccgugcug

SEQ ID NO: 31958 - RNA, 333 nt, Artificial Sequence
  derived and/or modified sequence opt4 from anti-HIV_V3_LightChain
cagagcgugcugacccagccccccagcgccagcggcacccccggccagagagugaccaucagcugcagcggcagcagcagcaacaucggcagcaacaccgugaacugguaccagcaccugcccggcaccgcccccaagcugcugaucuacagcaacgaccagagacccagcggcgugcccgacagauucagcggcagcagcagcggcaccagcgccagccuggccaucagcggccugcagagcgaggacgaggccgacuacuacugcgccgccugggacgacagccugaacggccccuucguguucggcaccggcaccaaggugaccgugcug

SEQ ID NO: 31959 - RNA, 318 nt, Artificial Sequence
  derived and/or modified sequence opt4 from anti-HIV_V3_LightChain
gacauccagaugacccagagccccagcagccugagcgccagcgugggcgacagaaucaccaucaccugcagaaccagccagagcaucgacaaccaccugaacugguaccagcacaagcccggcaaggcccccaagcugcugaucagcgccgccagcagacugcagagcggcgugcccagcagauucaccggcagcggcagcggcaccgaguucacccugaccaucagcagccugcagcccgaggacuucgccguguacuacugccagcagagcuacaucaccaucaccuucggccccggcaccaagguggacaucaag

SEQ ID NO: 31960 - RNA, 321 nt, Artificial Sequence
  derived and/or modified sequence opt4 from anti-HIV_V3_LightChain
gagaucgugaugacccagagccccgccacccugagcgugagccccggcgagggcgugacccugagcugcagagccagccagagcgugagcagcaacauccugugguaccagcagagacccggccaggcccccagacugcugcuguacggcgccagcaccagagccaccggcauccccgccagauucagcggcagcggcagcggcaccgaguucacccugaccaucaacagcaugcagagcgaggacuucgccaucuacuacugccagcaguaccacgacuggcuguggacccugggccagggcacccagguggagaucaag

SEQ ID NO: 31961 - RNA, 327 nt, Artificial Sequence
  derived and/or modified sequence opt4 from anti-HIV_V3_LightChain
agcuacgagcugacccagccccccagcgugagcgugagccccggccagaccgccagcaucaccugcagcggcgacaagaugggcgagagauacaccagcugguaccagcagaagcccggccagagccccgugcuggugaugagcgagaacaucaagagacccgccggcauccccgagagauucagcggcagcagcagcggcaacaccgccauccugaccaucagcggcacccaggccguggacgaggccgacuacuacugccaggugugggacaccaccaccaccagcuacgugaucuucggcggcggcaccaagcugaccgugcug

SEQ ID NO: 31962 - RNA, 321 nt, Artificial Sequence
  derived and/or modified sequence opt4 from anti-HIV_V3_LightChain
gacauccagaugacccagagccccagcagccugagcgccagcgugggcgacagagugaccaucaccugccaggccagccaggacaucggcaacuaccugaacugguaccaccagaagcccggcaaggcccccaagcugcugaucuacgacgccagcaacguggagaccggcguggccagcagauucagcggcagcggcagcggcaccgacuucacccugaccaucagcagccugcagcccgaggacaucggcaccuacuucugccagcaguacgagagccugcccugggccuucggcggcggcaccaagguggagaucaga

SEQ ID NO: 31963 - RNA, 333 nt, Artificial Sequence
  derived and/or modified sequence opt4 from anti-HIV_V3_LightChain
aacuucaagcugacccagccccacagcgugagcgagagccccggcaagaccgugaccaucagcugcaccagaaccagcggcaccaucgccaccaacuacgugcagugguuccagcagagacccggcagcagccccaccaccaugaucuacgagaacgacaagagacccagcggcgugcccgacagauucagcggcagcaucgacaccagcagcaacagcgccagccugaccaucagcggccugaagaccgaggacgaggccgacuacuacugccagagcuacaacagcaccgacaucgugguguucggcggcggcaccaagcugaccgugcug

SEQ ID NO: 31964 - RNA, 327 nt, Artificial Sequence
  derived and/or modified sequence opt4 from anti-HIV_V3_LightChain
cagagcgugcugacccagccccccagcgugagcgccgcccccggccagaaggugaccaucagcugcagcggcagcagcagcaacaucggcaacaacauggugagcugguaccagcagcaccccggcaccgcccccaagcugcugaucuacgagaacagcaagagacccagcggcauccccgacagauucagcggcagcagaagcggcaccagcgccacccugggcaucaucggccugcagaccggcgacgaggccgaguacuacugcgccaccugggacggcagccugagaaccguguucggcggcggcaccaagcugaccgugcug

SEQ ID NO: 31965 - RNA, 324 nt, Artificial Sequence
  derived and/or modified sequence opt4 from anti-HIV_V3_LightChain
agcuacgagcugacccagccccccagcgugagcgugagccccggccagaccgccagaaucaccugcagcggcgacgcccugcccaaccaguacggcuacugguaccagcagaagcccggccaggcccccgugcuggugaucuucaaggacagcgagagacccagcggcauccccgagagauucagcggcagcagcagcggcaccaccgugacccugaccaucagcggcgugcaggccgaggacgaggccgacuacuacugccagagcgccgacagcagcggcaacuacgagguguucggcggcggcaccaagcugaccgugcug

SEQ ID NO: 31966 - RNA, 330 nt, Artificial Sequence
  derived and/or modified sequence opt4 from anti-HIV_V3_LightChain
cagagcgugcugacccagccccccagcgugagcgaggcccccagacagagagugaccaucagcugcagcggcagcagcagcaacaucggcaacaacgccgugaacugguaccagcaggugcccggcaaggcccccaagcugcugaucuacuacgacgaccugcugcccagcggcgugagcgacagauucagcggcagcaagagcggcagcagcgccagccuggccaucagcggccugcagagcgaggacgaggccgacuacuacugcgccgccugggacgacagccugaagguguacguguucggcaccggcaccagcgugaccgugcug

SEQ ID NO: 31967 - RNA, 333 nt, Artificial Sequence
  derived and/or modified sequence opt4 from anti-HIV_V3_LightChain
gacaucgugaugaaccagagcccccccagccuggccgugacccccggcgagcccgccagcaucagcugcagagccagccagagccugcuguacagcgacggccacaacuaccuggacugguaccugcagaagcccggccaggccccccagcugcugaucuaccugggcagcaccagagccagcggcgugcccgacagauucagcggcagcggcagcggcaccgacuucacccugaagaucagcagaguggaggccgaggacgugggcguguacuacugcaugcagccccugcagagcuacaccuucggccagggcaccaagcuggagaucaag

SEQ ID NO: 31968 - RNA, 321 nt, Artificial Sequence
  derived and/or modified sequence opt4 from anti-HIV_V3_LightChain
gccuacgagcugacccagccccccagcgugagcgugagccccggccagaccgccagaaucaccugcagcggcgacgcccugcccaaccaguacgccuacugguaccaccagagacccggccaggcccccgugcuggugauccacaaggacaccgagagacccagcggcauccccgccagauucagcggcagcagcagcggcaccaccgugacccugaccaucagcgaggugcaggccgaggacgagggcgacuacuacugccagagcgccgacaccagcgccuacgugguguucggcggcggcaccaagcugaccgugcug

SEQ ID NO: 31969 - RNA, 330 nt, Artificial Sequence
  derived and/or modified sequence opt4 from anti-HIV_V3_LightChain
cagagcgugcugacccaggcccccagcagcagcggcacccccggccagagcgugaccaucagcugcagcggcagcagcagcaacauggagaucaacuacguguacugguacagacaguuccccggcaccgccccccagcugcugaucuacaacgacaaccagagacccagcggcgugcccgacagauucagcgccagcaagagcggcaccagcgccagccuggccaucggcggccugagaagcgaggacgaggccgacuacuucugcgccguguggcacggcgacagaggcggccccguguucggcggcggcaccaagcugaccgugcug

SEQ ID NO: 31970 - RNA, 327 nt, Artificial Sequence
  derived and/or modified sequence opt4 from anti-HIV_V3_LightChain
agcuacgagcugaagcagcccagaagcgugagcgugagccccggccagaccgccagaaucaccugcagcggcgacgccaugcccaaccaguacgccuacugguaccagcagagacccggcagagcccccgugcugcugaucuucaaggacaacgagagagccagcggcauccccgagagaaucagcggcagcagcagcggcaccaccgccacccugaccaucaacagagugcaggccgaggacgaggccgacuaccugugccagagcgccgacagcagcggcgccuuccccuggguguucggcggcggcaccacccugaccgugcug

SEQ ID NO: 31971 - RNA, 324 nt, Artificial Sequence
  derived and/or modified sequence opt4 from anti-HIV_V3_LightChain
agcuacgagcugacccagccccccagcgugagcgugagccccggccagaccgccagaaucaccugcagcggcgacgcccugcccaaggaguacgccuacugguaccagcagaagagcggccaggcccccgugcuggugaucuacgaggacaccagaagacccagcggcauccccgagagauucagcggcagcagcagcggcaccauggccacccugaccgugagcggcgcccacguggacgacgaggccgacuacuacugcuacagcagagacaccagcgccaaccaguggguguucggcggcggcaccaagcugaccgugcug

SEQ ID NO: 31972 - RNA, 318 nt, Artificial Sequence
  derived and/or modified sequence opt4 from anti-HIV_V3_LightChain
gagaucgugcugacccagagccccgccacccugagccugagccccggcgagagagccacccugagcugcagagccagccagagcaucagcaccuaccugggcugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagauacaccuggaucaccuucggccagggcaccagacuggagaucaag

SEQ ID NO: 31973 - RNA, 327 nt, Artificial Sequence
  derived and/or modified sequence opt4 from anti-HIV_V3_LightChain
agcuacgagcugacccagccccccagcgugagcgugagccccggccagaccgccagaaucaccugcagcggcgacgcccugcccaaccaguacguguacugguaccagcagagacccggccaggcccccgugguggugcuguacaaggacaccgagagacccagcggcauccccgagagauucagcggcagcagcagcggcaccaccgugacccugaccaucagcggcgugcaggccgaggacgaggccgacuacuacugccagagcgccgacaacagcggcgccuacccccuguucuucggcggcggcaccaagcugaccgugcug

SEQ ID NO: 31974 - RNA, 333 nt, Artificial Sequence
  derived and/or modified sequence opt4 from anti-HIV_V3_LightChain
cagagcgugcugacccagccccccagcgugagcgccgcccccggccagaaggugaccaucagcugcagcggcagcagcagcaacaucggcaacaacuacgugcugugguaccagcaguuccccggcaccgcccccaagcugcugaucuacggcaacaacaagagacccagcggcauccccgacagauucagcggcagcaagagcggcaccagcgccacccugggcaucaccggccugcagaccggcgacgaggccgacuacuucugcgccaccugggacagcggccugagcgccgacuggguguucggcggcggcaccaagcugaccgugcug

SEQ ID NO: 31975 - RNA, 321 nt, Artificial Sequence
  derived and/or modified sequence opt4 from anti-HIV_V3_LightChain
gacauccagaugacccagagccccagcagccugagcgccagcgugggcgacagagugaccaucaccugcagagccagccaggagaucgacaacuaccuggccugguaccagcagagacccggcaaggcccccaagagccugaucuacgccgccagcagccugcagggcggcgugccccccaaguucagcggcagcggcagcggcaccgaguucacccugaccaucagcagccugcaggccgaggacuucgccaccuacuacugccagcaguacaacgccuacccccugaccuucggccagggcaccagacuggacaucaac

SEQ ID NO: 31976 - RNA, 324 nt, Artificial Sequence
  derived and/or modified sequence opt4 from anti-HIV_V3_LightChain
agcuacgagcugacccagccccccagccugagcgugagccccggccagaccgccagcaucaccugcagcggcgacggccugcccaagcaguacggcuacugguaccagcagaagcccggccaggccccccugcuggugauccugaaggacaccgagagacccagcggcauccccgagagauucagcggcagcagcagcggcaccaccgugacccugaccaucagcggcgugcaggccgaggacgaggccgacuacuacugccagagcguggacagcaccggcagcuacuacguguucggccccggcaccaaggugaccgugcug

SEQ ID NO: 31977 - RNA, 324 nt, Artificial Sequence
  derived and/or modified sequence opt4 from anti-HIV_V3_LightChain
agcuacgagcugacccagccccccagcgugagcgugagccccggccagaccgccagaaucaccugcagcggcgacgugcugcccaagaaguacgccuacugguaccagcagaagagcggccuggcccccgugcuggugaucuacgaggacaacagaagacccagcggcauccccgagagauucagcggcagcagcagcggcaccauggccacccugaccaucagcggcgcccagguggaggacgagggcgacuacuacugcagcagcaccgacagcagcggcgaccacuacguguucggcaccggcaccaaggugaccgugcug

SEQ ID NO: 31978 - RNA, 321 nt, Artificial Sequence
  derived and/or modified sequence opt4 from anti-HIV_V3_LightChain
gccuacgagcugacccagccccccagcgugagcgugagccccggccagaccgccagaaucaccugcagcgccgaggcccugagcaaccaguacgccuacugguacagacagagacccggccaggccccccugcugaucaucuacaaggacaccaagagacccagcggcauccccgagagauucagcggcagcaccagcggcaccaccgugacccugaccaucagcggcgugcaggccgaggacgaggccgacuacuacugccagagcgccgacagcagcggcgacuacguguucggcggcggcaccaaggugaccgugcug

SEQ ID NO: 31979 - RNA, 333 nt, Artificial Sequence
  derived and/or modified sequence opt4 from anti-HIV_CD4bs_LightChain
cagcccgugcugacccagagcagcagcgccagcgccagccugggcagcagcgugaagcugaccugcacccugggcagcggccacagcggcagcaucaucgccuggcaccagcagcagcccggcaaggcccccagauaccugaugaaggugcagagcagcggcagcuacaacaagggcagcggcgugcccgacagauucagcggcagcagcagcggcgccgacagauaccugaccaucagcaaccugcaguucgaggacgagggcgacuacuacugcgagaccugggacaccaacaaguacguguucggcaccggcaccaaggugaccgugcug

SEQ ID NO: 31980 - RNA, 324 nt, Artificial Sequence
  derived and/or modified sequence opt4 from anti-HIV_CD4bs_LightChain
gagcuggugcugacccagagccccggcacccugagccugagccccggcgagagagccacccugagcugcagagccagccagagcguggccagcuacuaccuggccugguaccagcagaagcccggccaggcccccagacugcugaucuacggcgccagcagcagagccaccggcauccccgacagauucagcggcagcgugagcggcaccgacuucacccugaccaucagcagacuggagcccgaggacuucgcccuguacuacugccagcaguacggcagcagcccccugagcuucggcggcggcaccaagguggagaucaga

SEQ ID NO: 31981 - RNA, 333 nt, Artificial Sequence
  derived and/or modified sequence opt4 from anti-HIV_CD4bs_LightChain
cagagcgcccugacccagccccccagcaugagcggcagccccggccagagcaucaccaucagcugcaccggcagcggcagcgacgugggcagccacaacuucgugagcugguaccagcagcaccccgccagagugcccaagcugcugaucuacgccgugggcaacagacccagcggcgugagcgagagauucagcggcagcaagagcggcaacaccgccuaccugaccaucagcggccugcaggccgacgacgaggccgacuacuacugcagcagccacaccaccggcaccacccuggagguguucggcggcggcaccagacugaccgugcug

SEQ ID NO: 31982 - RNA, 333 nt, Artificial Sequence
  derived and/or modified sequence opt4 from anti-HIV_CD4bs_LightChain
gacaucgugaugacccagagcccccugagccugcccgugacccccggcgagcccgccagcaucagcugcagaagcagcgagagccugcugcacagcaacggcuucaucuaccuggacugguaccugcagaagcccggccagagcccccagcugcugaucuaccugggcagcaagagagccagcggcgugagcgacagauucagcggcagcggcagcggcaccgccuucacccugaagaucagcagaguggaggccgaggacgugggcguguacuacugcaugcaggcccuggagagcagaaccuucggccagggcaccaagcuggagaucaag

SEQ ID NO: 31983 - RNA, 327 nt, Artificial Sequence
  derived and/or modified sequence opt4 from anti-HIV_CD4bs_LightChain
gagaucgugcugacccagagccccggcacccugagccugagccccggcgagagagccacccugagcugcagagccagccagagcgugagcagcagcuaccuggccugguaccagcagaagcccggccagagccccagacugcugaucuacggcgccagcagcagagccaccggcauccccgacagauucagcggcagcggcagcggcaccgacuucacccugaccaucagcagacuggagcccgaggacuucgccguguacuacugccagcacuacggcagcagcagcaucuucaccuucggccccggcaccaagguggacaucaga

SEQ ID NO: 31984 - RNA, 330 nt, Artificial Sequence
  derived and/or modified sequence opt4 from anti-HIV_CD4bs_LightChain
aacuucaugcugacccagccccacagcgugagcggcagccccggcaagaccgugaccaucagcugcaccagaagcagcggcagcaucgccggcaacuacgugcagugguaccagcagagacccggcaccagccccaccaccgugaucuacgagaacgaccagagaagcagcggcgugcccgacagauucagcggcagcaucgacagcagcagcaacagcgccagccugaccaucagcggccugaagaccgaggacgaggccgacuacuacugccacagcuacgacgccaccaaccagguguucggcggcggcaccaagcugaccgugcug

SEQ ID NO: 31985 - RNA, 333 nt, Artificial Sequence
  derived and/or modified sequence opt4 from anti-HIV_CD4bs_LightChain
gacgugguggugacccagagcccccugagccugcccgugacccugggccagcccgccagcaucagcugcagaagcagccagagccugguguacagcgacggcaccacccaccugaacugguaccaccagagacccggccagccccccagaagacugaucuacagagugagcaacagagacagcggcgugcccgacagauucagcggcagcggcagcggcaccgacuucacccugagaaucagcagaguggaggccgaggacgugggccuguacuacugcaugcuggccacccaccccuucaccuucggccccggcaccaagguggagaucaag

SEQ ID NO: 31986 - RNA, 336 nt, Artificial Sequence
  derived and/or modified sequence opt4 from anti-HIV_CD4bs_LightChain
cagagcgugcugacccagccccccagcgugagcggcgcccccggccagaccgugaccaucagcugcaccggcagcagcagcaacaucggccccagcuacgacgugcagugguaccagcaguuccccggcagagcccccaagcugcugaucagcggcaacaacaacagagccagcggcgugcccgacagauucagcggcagcaagagcggcaccagcgccagccuggccaucaccggccugcagagcgaggacgaggccgacuacuacugccagaccuacgacagcagccugagcggccacgugguguucggcggcggcaccagacugaccgugcug

SEQ ID NO: 31987 - RNA, 321 nt, Artificial Sequence
  derived and/or modified sequence opt4 from anti-HIV_CD4bs_LightChain
gacauccagaugacccagagccccagcacccugagcgccagcgugggcgacagagugaccaucaccugcagagccagcgccagcaucuacaccuggcuggccugguaccagcagagacccggcaaggcccccgaggugcugaucuacaaggccagcacccugaagagcggcgugcccagcagauucagcggcagcggcagcggcaccgaguucacccugaccaucagcagccugcagcccggcgacuucgccaccuacuacugccagcaguacaccaccuacccccugaccuucggcggcggcaccaccguggagaucaag

SEQ ID NO: 31988 - RNA, 330 nt, Artificial Sequence
  derived and/or modified sequence opt4 from anti-HIV_CD4bs_LightChain
cagagcgcccugacccagcccgccagcgugagcggcagccccggccagagcaucaccaucagcugcaccggcaccagcaacgacaucggcaccuacaaccuggugagcugguaccagcaccaccccaacaaggcccccaagguggugguguacgagaacaacaagagacccagcggcaucagcaacagauucagcggcagcaagagcggcaacaccgccagccugaccaucagcggccugcaggccgaggacgaggccgacuacuacugcugcagcuacgccggcagcagcaccuggguguucggcggcggcaccaagcugaccgugcug

SEQ ID NO: 31989 - RNA, 321 nt, Artificial Sequence
  derived and/or modified sequence opt4 from anti-HIV_V2_LightChain
gacauccagaugacccagagccccagcacccugagcgccagcgugggcgacagagugaccaucaccugcagagccagccagaccaucagcagcuggcuggccugguaccagcagaagagcggcaccgcccccaagcugcugaucuacaaggccagcagcaucgugagcggcgugcccagcagauucagcggcagcggcagcggcaccgaguucacccugaccaucaccagccugcagcccgacgacuucgccaccuacuacugccagcaguacaacagcagccccgagaccuucggccagggcaccaagguggagaucaag

SEQ ID NO: 31990 - RNA, 318 nt, Artificial Sequence
  derived and/or modified sequence opt4 from anti-HIV_V2_LightChain
gagaucgugcugacccagagccccggcacccugagccugagccccggcgagagagccacccugagcugcagagccagccagagcgugagcagcuaccuggccugguaccagcagaagcccggccaggcccccagacugcugaucuacgacgccagcagcagagccaccggcauccccgacagauucagcggcagcggcagcggcaccgacuucacccugaccaucagcagacuggagcccgaggacuucgccguguacuacugccagcacuacgccggcagcagaaccuucggccagggcaccaagguggagaucaag

SEQ ID NO: 31991 - RNA, 333 nt, Artificial Sequence
  derived and/or modified sequence opt4 from anti-HIV_V2_LightChain
cagagcgugcugacccagccccccagcgugagcggcgcccccggccagagagugaccaucagcugcaccggcagcagcagcaacaucggcgcccacuacgacgugcacugguaccagcagcugcccggcaccgcccccaagcugcugaucuacggcaacagcaacagacccagcggcgugcccgacagauucagcggcagcaagagcggcaccagcgccagccuggccaucaccggccugcaggccgaggacgaggccgacuacuacugccagagcuacgacagcagccugagcggcuacguguucggcaccggcaccaaggugaccgugcug

SEQ ID NO: 31992 - RNA, 324 nt, Artificial Sequence
  derived and/or modified sequence opt4 from anti-HIV_V2_LightChain
gacaccgugaugacccagagccccgccacccugagcgugagccccggcgagagagugacccugagcugcagagccagccagaucaucaacaccaaccuggccugguaccagaagagacccggccaggcccccagacugcugaucuacgccgccagcgccagagccaccggcauccccgccagauucagcggcagcggcagcggcaccgaguucacccugaccaucagcggccugcagagcgaggacagcgccguguacuacugccagcaguacaagcacuggccccccuacaccuucggcagaggcaccaagcuggagaucaga

SEQ ID NO: 31993 - RNA, 321 nt, Artificial Sequence
  derived and/or modified sequence opt4 from anti-HIV_V2_LightChain
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagcagaaccuucggccagggcaccaagguggagaucaag

SEQ ID NO: 31994 - RNA, 321 nt, Artificial Sequence
  derived and/or modified sequence opt4 from anti-HIV_V2_LightChain
gacauccagaugacccagagccccagcagccugagcgccagcgugggcgacagagugaccaucaccugcagagccagccagagcaucagcggcaaccugaacugguaccagcagaagcccggcaaggcccccaaccugcugaucuacggcgccagcagccugcagagcggcgugcccagcagauucagcggcagcggcagcggcaccgacuucacccugaccaucagcagccugcagcccgaggacuucgccaccuaccacugccagcagagccacagcaccagcuggaccuucggccagggcaccaagguggugaucaag

SEQ ID NO: 31995 - RNA, 327 nt, Artificial Sequence
  derived and/or modified sequence opt4 from anti-HIV_10E8
gccagcgagcugacccaggaccccaccgugagcguggcccugggccagaccgugaccaucaccugcagaggcgacagccugagaaaccacuacaccagcugguaccagcagaagaccggccaggcccccgugcugcugaucuaccccaagcacaacagaagccccggcaucagcgacagauucagcgccagcagcagcggcaacaccgccagccugaccaucaccggcgcccagaccgaggacgagggcgacuacuacugcagcagcagagacaagagcggcagcagacuggugaccuucggcggcggcaccgaggugaccggccug

SEQ ID NO: 31996 - RNA, 327 nt, Artificial Sequence
  derived and/or modified sequence opt4 from anti-HIV_10E8
gccagcgagcugacccaggaccccaccgugagcguggcccugggccagaccgugaccaucaccugcagaggcgacagccugagaaaccacuacaccagcugguaccagcagaagaccggccaggcccccgugcugcugaucuaccccaagcacaacagaagccccggcaucagcgacagauucagcgccagcagcagcggcaacaccgccagccugaccaucaccggcgcccagaccgaggacgagggcgacuacuacugcagcagcagagacaagagcggcagcagacuggugaccuucggcggcggcaccaaggugaccguggug

SEQ ID NO: 31997 - RNA, 327 nt, Artificial Sequence
  derived and/or modified sequence opt4 from anti-HIV_10E8
gccagcgagcugacccaggaccccaccgugagcguggcccugggccagaccgugaccaucaccugcagaggcgacagccugagaaacuacuacaccagcugguaccagcagaagcccggccaggcccccgugcugcugaucuaccccaagcacaacagaccccccggcaucagcgacagauucagcgccagcagcagcggcaacaccgccagccugaccaucaccggcgcccagaccgaggacgagggcgacuacuacugcagcagcagagacaagagcggcagcagacuggugaccuucggcggcggcaccaaggugaccggccug

SEQ ID NO: 31998 - RNA, 327 nt, Artificial Sequence
  derived and/or modified sequence opt4 from anti-HIV_10E8
gccagcgagcugacccaggaccccaccgugagcguggcccugggccagaccgugaccaucaccugcagaggcgacagccugagaaacuacuacaccagcugguaccagcagaagcccggccaggcccccgugcugcugaucuaccccaagcacaacagaccccccggcaucagcgacagauucagcgccagcagcagcggcaacaccgccagccugaccaucaccggcgcccagaccgaggacgagggcgacuacuacugcagcagcagagacaagagcggcagcagacuggugaccuucggcagaggcaccaagcugaccguggug

SEQ ID NO: 31999 - RNA, 327 nt, Artificial Sequence
  derived and/or modified sequence opt4 from anti-HIV_10E8
gccagcgagcugacccaggaccccaccgugagcguggcccugggccagaccgugaccaucaccugcagaggcgacagccugagaaaccacuacaccagcugguaccagcagaagaccggccaggcccccgugcugcugaucuaccccaagcacaacagaagccccggcaucagcgacagauucagcgccagcagcagcggcaacaccgccagccugaccaucaccggcgcccagaccgaggacgagggcgacuacuacugcagcagcagagacaagagcggcagcagacuggugaccuucggcggcggcaccaaggugaccgugcug

SEQ ID NO: 32000 - RNA, 327 nt, Artificial Sequence
  derived and/or modified sequence opt4 from anti-HIV_10E8
gccagcgagcugacccaggaccccaccgugagcguggcccugggccagaccgugaccaucaccugcagaggcgacagccugagaaacuacuacaccagcugguaccagcagaagcccagacaggcccccgugcugcugaucuaccccaagcacaacagaccccccggcaucagcgacagauucagcgccagcagcagcggcaacaccgccagccugaccaucaccggcgcccagaccgaggacgagggcgacuacuacugcagcagcagagacaagagcggcagcagacuggugaccuucggcggcggcaccaagcugaccgugcug

SEQ ID NO: 32001 - RNA, 327 nt, Artificial Sequence
  derived and/or modified sequence opt4 from anti-HIV_10E8
gccagcgagcugacccaggaccccaccgugagcguggcccugggccagaccgugaccaucaccugcagaggcgacagccugagaaacuacuacaccagcugguaccagcagaagcccggccaggcccccgugcugcugaucuaccccaagcacaacagaccccccggcaucagcgacagauucagcgccagcagcagcggcaacaccgccagccugaccaucaccggcgcccagaccgaggacgagggcgacuacuacugcagcagcagagacaagagcggcagcagacuggugaccuucggcggcggcaccaagcugaccgugcug

SEQ ID NO: 32002 - RNA, 327 nt, Artificial Sequence
  derived and/or modified sequence opt4 from anti-HIV_10E8
gccagcgagcugacccaggaccccaccgugagcguggcccugggccagaccgugaccaucaccugcagaggcgacagccugagaaaccacuacaccagcugguaccagcagaagaccggccaggcccccauccugcugaucuaccccaagcacaacagaccccccggcaucagcgacagauucagcgccagcagcagcggcaacaccgccagccugaccaucaccggcgcccagaccgaggacgagggcgacuacuacugcagcagcagagacaagagcggcagcagacuggugaccuucggcggcggcaccaagcugaccgugcug

SEQ ID NO: 32003 - RNA, 327 nt, Artificial Sequence
  derived and/or modified sequence opt4 from anti-HIV_10E8
agcagcgaccugacccaggaccccgccgugagcguggcccugggccagaccgugagaaucaccugccagggcgacagccugagaagauacuacgccggcugguaccagcagaagcccggccaggcccccgugcuggugguguacggcagagacaacagacccagcggcauccccgacagauucagcggcagcaccagcggcaacaccgccagccugaccaucgccggcgcccaggccgaggacgacgccgacuacuacugcagcagcagagacaagagcggcagcagacugagcguguucggcggcggcaccaagcugaccgugcug

SEQ ID NO: 32004 - RNA, 327 nt, Artificial Sequence
  derived and/or modified sequence opt4 from anti-HIV_10E8
gccagcgagcugacccaggaccccgccgugagcguggccuucgagaagaccgugaccaucaccugccagggcgacagccugagaagccacuacgugagcugguaccagaagagacccggccaggcccccgugcugguguucuacggcaagaacaacagacccagcggcauccccgacagauucagcggcagcaccagcggcaacaccgccagccugaccaucgccggcgcccaggccgaggacgacgccgacuacuacugcagcagcagagacaagagcggcagcagacugagcguguucggcggcggcaccaagcugaccgugccc

SEQ ID NO: 32005 - RNA, 327 nt, Artificial Sequence
  derived and/or modified sequence opt4 from anti-HIV_10E8
gccagcgagcugacccaggaccccgccgugagcguggcccugaagcagaccgugaccaucaccugcagaggcgacagccugagaagccacuacgugagcugguaccagcagaagcccggccaggcccccgugcugguguucuacggcaagaacaacagacccagcggcauccccgacagauucagcggcagcagcagcggcaacaccgccagccugaccaucgccggcgcccaggccgaggacgacgccgacuacuacugcagcagcagagacaagagcggcagcagacugagcguguucggcggcggcaccaagcugaccgugcug

SEQ ID NO: 32006 - RNA, 327 nt, Artificial Sequence
  derived and/or modified sequence opt4 from anti-HIV_10E8
agcagcgagcugacccaggaccccggcgugagcguggcccugaagcagaccgugaccaucaccugcagaggcgacagccugagaagccacuacgugagcugguaccagaagaagcccggccaggcccccgugcugguguucuacggcaagaacaucggccccagcggcauccccgacagauucagcggcagcaccagcggcaacaccgccagccugaccaucgccggcgcccaggccgaggacgacgccgacuacuacugcagcagcagagacaagagcggcagcagacugagcguguucggcggcggcaccaagcugaccgugcug

SEQ ID NO: 32007 - RNA, 327 nt, Artificial Sequence
  derived and/or modified sequence opt4 from anti-HIV_10E8
gccagcgagcugacccaggaccccgccgugagcguggcccugaagcagaccgugaccaucaccugcagaggcgacagccugagaagccacuacgugagcugguaccagaagaagcccggccaggcccccgugcugguguucuacggcaagaacaacagacccagcggcauccccgacagauucagcggcagcagcagcggcaacaccgccagccugaccaucgccggcgcccaggccgaggacgacgccgacuacuacugcagcagcagagacaagagcggcagcagacugagcguguucggcggcggcaccaagcugaccgugcug

SEQ ID NO: 32008 - RNA, 327 nt, Artificial Sequence
  derived and/or modified sequence opt4 from anti-HIV_10E8
gccagcgagcugacccaggaccccggcgugagcguggcccugaagcagaccgugaccaucaccugcagaggcgacagccugagaagccacuacgugagcugguaccagaagagacccggccaggcccccgugcugguguucuacggcaagaacaacagacccagcggcauccccgacagauucagcggcagcaccagcggcaacaccgccagccugaccaucgccggcgcccaggccgaggacgacgccgacuacuacugcagcagcagagacaagagcggcagcagacugagcguguucggcggcggcaccaagcugaccgugcug

SEQ ID NO: 32009 - RNA, 327 nt, Artificial Sequence
  derived and/or modified sequence opt4 from anti-HIV_10E8
gccagcgagcugacccaggaccccggcgugagcguggcccuggagcagaccgugaccaucaccugcagaggcgacagccugagaagccacuacgugagcugguaccagaagaagcccggccaggcccccgugcugguguucuacggcaagaacaacagacccagcggcauccccgacagauucagcggcagcaccagcggcaacaccgccagccugaccaucgccggcgcccaggccgaggacgacgccgacuacuacugcagcagcagagacaagagcggcagcagacugagcguguucggcggcggcaccaagcugaccgugcug

SEQ ID NO: 32010 - RNA, 327 nt, Artificial Sequence
  derived and/or modified sequence opt4 from anti-HIV_10E8
gccagcgagcugacccaggaccccggcgugagcguggcccugaagcagaccgugaccaucaccugcagaggcgacagccugagaagccacuacgugagcugguaccagaagaagcccggccaggcccccgugcugguguucuacggcaagaacaacagacccagcggcauccccgacagauucagcggcagcaccagcggcaacaccgccagccugaccaucgccggcgcccaggccgaggacgacgccgacuacuacugcagcagcagagacaagagcggcagcagacugagcguguucggcggcggcaccaagcugaccgugcug

SEQ ID NO: 32011 - RNA, 327 nt, Artificial Sequence
  derived and/or modified sequence opt4 from anti-HIV_10E8
agcagcgagcugacccaggaccccggcgugagcguggcccugaagcagaccgugaccaucaccugcagaggcgacagccugagaagccacuacgugagcugguaccagaagaagcccggccaggcccccgugcugguguucuacggcaagaacaacagacccagcggcauccccgacagauucagcggcagcaccagcggcaacaccgccagccugaccaucgccggcgcccaggccgaggacgacgccgacuacuacugcagcagcagagacaagagcggcagcagacugagcguguucggcggcggcaccaagcugaccgugcug

SEQ ID NO: 32012 - RNA, 327 nt, Artificial Sequence
  derived and/or modified sequence opt4 from anti-HIV_10E8
agcagcgagcugacccaggagaccggcgugagcguggcccugggcagaaccgugaccaucaccugcagaggcgacagccugagaagccacuacgccagcugguaccaggagaagcccggccaggcccccaagcugcuguucuacggcaagaacaacagacccagcggcauccccgacagauucagcggcagcgccagcggcaacagagccagccugaccaucagcggcgcccaggccgaggacgacgccgaguacuacugcagcagcagagacaagagcggcagcagacugagcguguucggcggcggcaccaagcuggccgugcug

SEQ ID NO: 32013 - RNA, 327 nt, Artificial Sequence
  derived and/or modified sequence opt4 from anti-HIV_10E8
agcagcgagcugacccaggagaccggcgugagcguggcccugggcagaaccgugaccaucaccugcagaggcgacagccugagaagccacuacgccagcugguaccagaagaagcccggccaggcccccaagcugcuguucuacggcaagaacaacagacccagcggcauccccgacagauucagcggcuucgccagcggcaacagagccagccugaccaucagcggcgcccaggccgaggacgacgccgaguacuacugcagcagcagagacaagagcggcagcagacugagcguguucggcggcggcaccaagcugaccgugcug

SEQ ID NO: 32014 - RNA, 327 nt, Artificial Sequence
  derived and/or modified sequence opt4 from anti-HIV_10E8
agcagcgagcugacccaggagaccggcgugagcguggcccugggcagaaccgugaccaucaccugcagaggcgacagccugagaagccacuacgccagcugguaccagaagaagcccggccaggcccccaagcugcuguucuacggcaagaacaacagacccagcggcauccccgacagauucagcggcagcgccagcggcaacagagccagccugaccaucagcggcgcccaggccgaggacgacgccgaguacaucugcagcagcagagacaagagcggcagcagacugagcguguucggcggcggcaccaagcugaccgugcug

SEQ ID NO: 32015 - RNA, 327 nt, Artificial Sequence
  derived and/or modified sequence opt4 from anti-HIV_10E8
agcagcgagcugacccaggagaccggcgugagcguggcccugggcagaaccgugaccaucaccugcagaggcgacagccugagaagccacuacgccagcugguaccagaagaagcccggccaggcccccaagcugcuguucuacggcaagaacaacagacccagcggcauccccgacagauucagcggcagcgccagcggcaacagagccagccugaccaucagcggcgcccaggccgaggacgacgccgaguacuacugcagcagcagagacaagagcggcagcagacugagcguguucggcggcggcaccaagcugaccgugcug

SEQ ID NO: 32016 - RNA, 327 nt, Artificial Sequence
  derived and/or modified sequence opt4 from anti-HIV_10E8
agcagcgagcugacccaggagaccggcgugagcguggcccugggcagaaccgugaccaucaccugcagaggcgacagccugagaagccacuacgccagcugguaccagaagaagcccggccaggcccccauccugcuguucuacggcaagaacaacagacccagcggcauccacgacagauucagcggcagcgccagcggcaacagagccagccugaccaucagcggcgcccaggccgaggacgacgccgaguacuacugcagcagcagagacaagagcggcagcagacugagcguguucggcggcggcaccaagcugaccgugcug

SEQ ID NO: 32017 - RNA, 393 nt, Artificial Sequence
  derived and/or modified sequence opt4 from anti-HIV_10E8
gaggugcagcugguggagagcggcggcgaccuggugaagcccggcggcagccugagacugagcugcagcgccagcggcuucagcuucaagaacaccuggaugaccugggugagacaggcccccggcaagggccuggagugggugggcagaaucaccggccccggcgagggcuggaccagcgacuacgccgccaccgugcagggcagauucaccaucagcagaaacaacaugaucgacaugcuguaccuggagaugaacagacugagaaccgacgacaccggccuguacuacugcgugcacaccgagaaguacuacaacuucuggggcggcuacccccccggcgaggaguacuuccagcacuggggcagaggcacccuggugaucgugagcagc

SEQ ID NO: 32018 - RNA, 393 nt, Artificial Sequence
  derived and/or modified sequence opt4 from anti-HIV_10E8
gagaucagacugguggagagcggcggcggccuggugaagcccggcggcagccugagacugagcugcagcgccagcggcuucaacuucgacagcgccuggaugaccugggugagacagccccccggcaagggccuggagugggugggcagaaucaccggccccggcgagggcuggagcgugggcuacgccgagagcgugaagggcagauucaucaucagcagaaucaacagcaucaacuuccuguaccuggagaugaacaaccugagacccgaggacaccggcagcuacuucugcgcccacaccggcaagcacuacgacuucuggagaggcuacccccccggcgaggaguacuuccaggacuggggccagggcacccaggugaucgugagcagc

SEQ ID NO: 32019 - RNA, 393 nt, Artificial Sequence
  derived and/or modified sequence opt4 from anti-HIV_10E8
gagaucagacugguggagagcggcggcggccuggugaagcccggcggcagccugagacugagcugcagcgccagcggcuucaacuucgacagcgccuggaugaccugggugagacagccccccggcaagggccuggagugggugggcagaaucaccggccccggcgagggcuggagcguggacuacgccgagagcgugaagggcagauucaucaucagcagaaucaacagcaucaacuuccuguaccuggagaugaacaaccugagacccgaggacaccggcagcuacuucugcgcccacaccggcaagcacuacgacuucuggagaggcuacccccccggcgaggaguacuuccaggacuggggccagggcacccaggugaucgugagcagc

SEQ ID NO: 32020 - RNA, 393 nt, Artificial Sequence
  derived and/or modified sequence opt4 from anti-HIV_10E8
gaggugagacugguggagagcggcggcagacuggugagacccggcggcagccugagacugagcugcagcgccagcggcuucaacuucgacaacgccuggaugaccugggugagacagccccccggcaagggccuggagugggugggcagaaucaccggccccggcgagggcuggagcguggacuacgccgccagcgugaagggcagauucaccaucagcagaaugaacagcaucaacuucuucuaccuggagaugaacaaccugaagaucgaggacaccggccuguacuucugcgccagaaccggcaagcacuacgccuucuggggcggcuacccccccggcgaggaguaccuggaggacuggggccagggcacccuggugaucgugagcagc

SEQ ID NO: 32021 - RNA, 393 nt, Artificial Sequence
  derived and/or modified sequence opt4 from anti-HIV_10E8
gaggugagacugguggagagcggcggcggccuggugaagcccggcggcagccugagacugagcugcagcgccagcggcuucaacuucgacgacgccuggaugaccugggugagacagccccccggcaagggccuggagugggugggcagaaucagcggccccggcgagggcuggagcguggacuacgccgagagcgugaagggcagauucaccaucagcagacugaacagcaucaacuuccuguaccuggagaugaacaacgugagaaccgaggacaccggcuacuacuucugcgccagaaccggcaagcacuacgacuucuggagcggcuacccccccggcgaggaguacuuccaggacuggggccagggcacccuggugaucgugagcagc

SEQ ID NO: 32022 - RNA, 393 nt, Artificial Sequence
  derived and/or modified sequence opt4 from anti-HIV_10E8
gaggugagacuggccgagagcggcggcggccuggugaagcccggcggcagccugagacugagcugcagcgccagcggcuucgacuucgacaacgccuggaugaccugggugagacagccccccggcaagggccuggagugggugggcagaaucaccggccccggcgagggcuggagcguggacuacgccgcccccguggagggcagauucaccaucagcagacugaacagcaucaacuuccuguaccuggagaugaacaaccugagaauggaggacagcggccuguacuucugcgccagaaccggcaaguacuacgacuucuggagcggcuacccccccggcgaggaguacuuccaggacuggggccagggcacccuggugaucgugcccagc

SEQ ID NO: 32023 - RNA, 393 nt, Artificial Sequence
  derived and/or modified sequence opt4 from anti-HIV_10E8
gaggugagacugguggagagcggcggcggccuggugaagcccggcggcagccugagacugagcugcagcgccagcggcuucgacuucgacaacgccuggaugaccugggugagacagccccccggcaagggccuggagugggugggcagaaucaccggccccggcgagggcuggagcguggacuacgccgcccccguggagggcagauucaccaucagcagacugaacagcaucaacuuccuguaccuggagaugaacaaccugagaauggaggacagcggccuguacuucugcgccagaaccggcaaguacuacgacuucuggagcggcuacccccccggcgaggaguacuuccaggacuggggccagggcacccuggugaucgugcccagc

SEQ ID NO: 32024 - RNA, 393 nt, Artificial Sequence
  derived and/or modified sequence opt4 from anti-HIV_10E8
gaggugagacugguggagagcggcggcggccuggugaagcccggcggcagccugagacugagcugcagcgccagcggcuucgacuucgacaacgccuggaugaccugggugagacagccccccggcaagggccuggagugggugggcagaaucaccggccccggcgagggcuggagcguggacuacgccgcccccguggagggcagauucaccaucagcagacugaacagcaucaacuuccuguaccuggagaugaacaaccugagaauggaggacagcggccuguacuucugcgccagaaccggcaaguacuacgacuucuggagcggcuacccccccggcgaggaguacuuccaggacuggggccagggcacccuggugaucgugagcagc

SEQ ID NO: 32025 - RNA, 393 nt, Artificial Sequence
  derived and/or modified sequence opt4 from anti-HIV_10E8
gaggugagacuggccgagagcggcggcggccuggugaagcccggcggcagccugagacugagcugcagcgccagcggcuucgacuucgacaacgccuggaugaccugggugagacagccccccggcaagggccuggagugggugggcagaaucaccggccccggcgagggcuggagcguggacuacgccgcccccguggagggcagauucaccaucagcagacugaacagcaucaacuuccuguaccuggagaugaacaaccugagaauggaggacagcggccuguacuucugcgccagaaccggcaaguacuacgacuucuggagcggcuacccccccggcgaggaguacuuccaggacuggggcagaggcacccuggugaucgugagcagc

SEQ ID NO: 32026 - RNA, 393 nt, Artificial Sequence
  derived and/or modified sequence opt4 from anti-HIV_10E8
gaggugagacugguggagagcggcggcggccuggugaagcccggcggcagccugagacugagcugcagcgccagcggcuucgacuucgacaacgccuggaugaccugggugagacagccccccggcaagggccuggagugggugggcagaaucaccggccccggcgagggcuggagcguggacuacgccgcccccguggagggcagauucaccaucagcagacugaacagcaucaacuuccuguaccuggagaugaacaaccugagaauggaggacagcggccuguacuucugcgccagaaccggcaaguacuacgacuucuggagcggcuacccccccggcgaggaguacuuccaggacuggggcagaggcacccuggugaucgugagcagc

SEQ ID NO: 32027 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagaagcagcaacaucggcaacaacaacguguucugguaccagcagcugcccggcaccgcccccaagcugcugaucuacgacaacgacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32028 - RNA, 336 nt, Artificial Sequence
  derived and/or modified sequence opt4 from anti-HIV-1_LightChain
cagagcgugcugacccagcccgccagcgugagcggcagccccggccagagcaucaccaucagcugcaccggcaccaagagcgacaucggcggcuacaaguacgugagcugguaccagcagcaccccggcaaggcccccaagauccugaucuacgacgugaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32029 - RNA, 321 nt, Artificial Sequence
  derived and/or modified sequence opt4 from anti-HIV-1_LightChain
cagagcgugcugacccagccccccagcgugagcgccgcccccggccagagagugaccaucagcugcuucggcagcagauucagcagcgugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32030 - RNA, 333 nt, Artificial Sequence
  derived and/or modified sequence opt4 from anti-HIV-1_LightChain
cagagcgugcugacccagccccccagcgccagcggcacccccggccagaccaucaccaucagcugcagcggcagcagcagcaacaucggcagcaacgacguguacugguaccagcaccugcccggcaccacccccaagguggugaucuacaagaacaacagaagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32031 - RNA, 327 nt, Artificial Sequence
  derived and/or modified sequence opt4 from anti-HIV-1_LightChain
cagagcgugcugacccagccccccagcaugagcgccgcccccggccagaaggugaccaucagcugcagcggcagcaccagcaucaucggcaacaacuacaucagcugguaccagcagcugcccggcaccgcccccaagcugcugaucuacgaggacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugacc

SEQ ID NO: 32032 - RNA, 333 nt, Artificial Sequence
  derived and/or modified sequence opt4 from anti-HIV-1_LightChain
cagagcgugcugacccagccccccagcgugagcgccgcccccggccugaaggugaccaucagcugcagcggcaacaccagcaacgugggcgacaacuucgugagcugguacagauaccugcccggcaccgcccccaagcugcugagcuacgaggacgacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32033 - RNA, 333 nt, Artificial Sequence
  derived and/or modified sequence opt4 from anti-HIV-1_LightChain
cagagcgugcugacccagccccccagcgccagcggcacccccggccagagagugaccaucagcugcagcggcagcagcagcaacaucggcagcaacaccgugaacugguaccagcaguuccccggcaccgcccccaagcugcugaucuacgagaacaacagaagacccagcggcgugcccgccagauucagcggcagcaagagcggcaccagcgccacccuggccaucaccggccugcagaccggcgacgaggccgacuacuacugcgccaccugggacagcagccugagcgccggcggcguguucggcaccggcaccaaggugaccgugcug

SEQ ID NO: 32034 - RNA, 318 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcacc

SEQ ID NO: 32035 - RNA, 288 nt, Artificial Sequence
  derived and/or modified sequence opt4 from anti-HIV-1_LightChain
ggccugagccccagccugugcagcggcagcagcagcaacaucggcaacaacuacgugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgagggcgacuacuacugcggcaccugggacagaagccugagcgccggcggcguguucggcaccggcaccaaggugaccgugcug

SEQ ID NO: 32036 - RNA, 333 nt, Artificial Sequence
  derived and/or modified sequence opt4 from anti-HIV-1_LightChain
caguucgugcugacccagccccccagcgugagcgccgcccccggccagagagugaccgugagcugcagcggcaccaccagcgacaucggcgagaacuacgugagcugguaccagaaguucagcgaggccgcccccaagcugcugcuguacgacaacgacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32037 - RNA, 327 nt, Artificial Sequence
  derived and/or modified sequence opt4 from anti-HIV-1_LightChain
cagagcgugcugacccagccccccagcgugagcgccgcccccggccagaaggugaccaucagcugcagcggcggcagcagcaacaucggcaacuacuacgugagcugguaccugcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugacc

SEQ ID NO: 32038 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcaacaugagcaacaucggcgacaacgccgugagcugguacagacaggugcccgaggcccccccccagcugcugaucuucggcaacgacaagagacccagcggcgugaccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32039 - RNA, 336 nt, Artificial Sequence
  derived and/or modified sequence opt4 from anti-HIV-1_LightChain
cagagcgugcugacccagccccccagcgugagcggcgcccccggccagagagugaccaucagcugcaccggcagcagcagcaacaucggcgccggcuacgacgugcacugguaccugcagcugcccggcaccgcccccagacugcugaucuacgacaacgacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32040 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcaccagcaacaucggcaacaacuucgugagcugguaccagcagcugcccggcaccgcccccaagcugcuguucuacgacaacuacaagagacccagcggcauccccgacagauucagcggcagcaagagcggcaccagcgccacccuggccaucaccggccugcagaccggcgacgaggccgacuacuacugcgccaccugggacagcagccugagcgccggcggcguguucggcaccggcaccaaggugaccgugcug

SEQ ID NO: 32041 - RNA, 336 nt, Artificial Sequence
  derived and/or modified sequence opt4 from anti-HIV-1_LightChain
cagagcgugcugacccagccccccagcgugagcggcgcccccggccagagagugaccaucagcugcaccggcggcagcagcaacaucggcgccggcuacgacgugcacugguaccagcaccugcccggcaccgccccccagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32042 - RNA, 333 nt, Artificial Sequence
  derived and/or modified sequence opt4 from anti-HIV-1_LightChain
cagagcgugcugacccagccccccagccugagcgccgcccccggccagagagugaccgugagcugcagcggcagcagcagcaacaucggcgacaacuacgugagcugguaccagcagcugcccggcgccgcccccagacugcugaucuacgagaacaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32043 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagaagcagcaacaucggcaacuacuucgugagcugguaccagcaguuccccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32044 - RNA, 333 nt, Artificial Sequence
  derived and/or modified sequence opt4 from anti-HIV-1_LightChain
cagagcgugcugacccagccccccagcgccagcggcacccccggccagagagugaccaucagcugcagcggcagcagcagcaacaucggcagcaacgccgugcacugguucagacagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcgccaccugggacagcagccugagcgccggcggcguguucggcaccggcaccaaggugaccgugcug

SEQ ID NO: 32045 - RNA, 333 nt, Artificial Sequence
  derived and/or modified sequence opt4 from anti-HIV-1_LightChain
cagagcgugcugacccagccccccagcgugagcgccgccagcggccagaaggugaccaucagcugcagcggcagcagcagcaacaucggcaacaacuacgugagcugguaccaccagcugcccggcaccgcccccaagcugcugaucuacgacaccaacaagagacccagcggcauccccgacagauucagcggcagcaccagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32046 - RNA, 333 nt, Artificial Sequence
  derived and/or modified sequence opt4 from anti-HIV-1_LightChain
cagcccgugcugacccagccccccagcgugagcgccgcccccggccagaccgugaccaucagcugcagcggcagcuucagcaacaucgagaccaacuacgugagcugguaccagcagcugcccggcaccgcccccaagcugcugaucuacgacaacaacaugagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 32047 - RNA, 336 nt, Artificial Sequence
  derived and/or modified sequence opt4 from anti-HIV-1_LightChain
cagcccgugcugacccagccccccagcgugagcggcgcccccggccagagagugaccaucagcugcaccggcagcagcagcaacaucggcgccggcuacgacgugcacugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32048 - RNA, 333 nt, Artificial Sequence
  derived and/or modified sequence opt4 from anti-HIV-1_LightChain
cagagcgugcugacccagccccccagccugagcgccgcccccggccagagaaucaccaucagcugcagcggcagcagcagcaacaucggcaacaacuacgugagcugguaccagcaguuccccggcaccgcccccaagcugcugaucuacgagaacaacaagagacccagcggcauccccgacagauucagcgccagcaagagcggcaccagcgccacccugggcaucaccggccugcagaccggcgacgaggccaacuacuacugcggcaccuggcacagcagccugagcgccggcggcguguucggcaccggcaccaaggugaccgugcug

SEQ ID NO: 32049 - RNA, 333 nt, Artificial Sequence
  derived and/or modified sequence opt4 from anti-HIV-1_LightChain
cagagcgugcugacccagccccccagcgugagcgccgcccccggccagagagugaccaucagcugcuucggcagcagauucaacgugggcaccagcagcgugagcugguaccagcagcugcccggcaccgcccccaagcugcugaucgacgccaacggcgagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32050 - RNA, 333 nt, Artificial Sequence
  derived and/or modified sequence opt4 from anti-HIV-1_LightChain
cagagcgugcugacccagccccccagcgugagcgccacccccggccagaaggugaccaucagcugcagcggcagcagaagcaacaucggcagccacuacgugagcugguaccagcaguuccccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32051 - RNA, 333 nt, Artificial Sequence
  derived and/or modified sequence opt4 from anti-HIV-1_LightChain
cagagcgugcugacccagccccccagcgccagcggcacccccggccagagagugaccaucagcugcagcggcagcagcagcaacaucggcagcaaccacguguacugguaccagcagcugcccggcaagacccccaagcugcugaucuacagaaacaaccagagacccagcggcauccccgacagauucagcggcagcaagagcggcaccagcgccacccugggcaucaccggccugcagaccggcgacgaggccgacuacuacugcggcaccugggacagcagccugagcaccggcggcguguucggcaccggcaccaaggugaccgugcug

SEQ ID NO: 32052 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcgccaacaucggcaacaacuacgugagcugguaccagcaguuccccggcaccggccccagacugaucaucuacgagagcaacaagagacccagcggcaucagcgacagauucagcggcagccagagcgacgccgccgccacccuggacaucaccggccugcagaccggcgacgaggccgacuacuacugcggcaccugggacagcagccugagcgccggcggcguguucggcaccggcaccagagugaccgugcug

SEQ ID NO: 32053 - RNA, 336 nt, Artificial Sequence
  derived and/or modified sequence opt4 from anti-HIV-1_LightChain
cagagcgugcugacccagccccccagcgugagcggcgcccccggccagaccgugaccaucagcugcaccggcgacaccagcaacaucggcgccgacuacagagugcacugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32054 - RNA, 333 nt, Artificial Sequence
  derived and/or modified sequence opt4 from anti-HIV-1_LightChain
cagagcgugcugacccagccccccagccugagcgccgcccccggccagagagugaccgugagcugcagcggcagcagcagcaacaucggcaacaacuacgugagcugguaccagcagcugcccggcgccgcccccaagcugcugaucuacaacaacaacaucagacccagcggcauccccgagagauucagcggcagcaagagcggcaccagcgccacccugggcaucaccggccugcagaccggcgacgagggcgacuacuacugcggcaccugggacagaagccugagcgccggcggcguguucggcaccggcaccaaggugaccgugcug

SEQ ID NO: 32055 - RNA, 333 nt, Artificial Sequence
  derived and/or modified sequence opt4 from anti-HIV-1_LightChain
cagagcgugcugacccagccccccagcgccagcggcacccccggccagagagugaccaucagcugcagcggcagcagcagcaacaucggcggcaacuacgugagcugguaccagcagcugcccggcaccgcccccaagcugcugaucagcgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32056 - RNA, 333 nt, Artificial Sequence
  derived and/or modified sequence opt4 from anti-HIV-1_LightChain
cagagccugcugacccagccccccagcgugagcgccgcccccggccagaaggugaccaucagcugcagcggcagcagcagcaacaucggcaacaacuucgugagcugguaccagcagcugcccggcaccgcccccaagcugcugaucuacgagaacaacaugagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32057 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcaccagcagcaacaucgccaacuacuacgugagcugguacagacagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32058 - RNA, 333 nt, Artificial Sequence
  derived and/or modified sequence opt4 from anti-HIV-1_LightChain
cagcccgugcugacccagccccccagcgugagcggcgcccccggccagagagugaccaucagcugcagcggcagcagcagcaacaucggcaacaacgacgugagcugguaccagcaggugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 32059 - RNA, 333 nt, Artificial Sequence
  derived and/or modified sequence opt4 from anti-HIV-1_LightChain
cagcuggugcugacccagccccccagcgugagcgccgcccccggccagagagugaccaucagcugcuucggcagcagauucaacgugggcaccagcagcgugagcugguaccagcagcugcccggcaccgcccccaagcugcugaucgacgccaacggcgagagacccagcggcauccccgacagauucuucggcagcgagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32060 - RNA, 333 nt, Artificial Sequence
  derived and/or modified sequence opt4 from anti-HIV-1_LightChain
agcuacgagcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 32061 - RNA, 333 nt, Artificial Sequence
  derived and/or modified sequence opt4 from anti-HIV-1_LightChain
cagagcgugcugacccagccccccagcgccagcggcacccccggccagagagugaccaucagcugcagcggcagcaccagcaacaucggcaccuacuacgugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgagggcgacuacuacugcggcaccugggacagaagccugagcgccggcggcguguucggcaccggcaccaaggugaccgugcug

SEQ ID NO: 32062 - RNA, 336 nt, Artificial Sequence
  derived and/or modified sequence opt4 from anti-HIV-1_LightChain
cagagcgcccugacccagcccgccagcgugagcgccagccccggccagagcaucgccaucagcugcaccggcaccagcagcgacgugggcagcuacaacuacgugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32063 - RNA, 330 nt, Artificial Sequence
  derived and/or modified sequence opt4 from anti-HIV-1_LightChain
cagagcgugcugacccagccccccagcgugagcgccgcccccggccagagagugaccaucagcugcagcggcggcagcagcaacaucggcaacaaccacgugagcugguaccagcaccugcccggcagagccccccagcugcugaucuacgacaccacccagagacccagcggcauccccgacagauucagcggcagcaagagcggcaccagcgccacccugggcaucaccggccugcagaccggcgacgaggccgacuacuacugcggcaccugggacagcagccugagcaccggcggcguguucggcaccggcaccaaggugaccgug

SEQ ID NO: 32064 - RNA, 333 nt, Artificial Sequence
  derived and/or modified sequence opt4 from anti-HIV-1_LightChain
cagagcgugcugacccagccccccagcgccagcggcacccccggccagagagugaccaucagcugcagcggcagcagcagcaacaucggcagcaaguacgugugcugguaccagcagcugcccggcaccgcccccaagcugcugaucuacagaaacaaccagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32065 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcgacagcagcaccuucgagaacgacuacgugugcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32066 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacggcaacagcaacagacccagcggcgugcccgacagauucagcggcagcaagagcggcaccagcgccagccuggccaucaccggccugcaggccgaggacgaggccgacuacuacugcggcaccugggacagcagccugagcgccggcggcguguucggcaccggcaccaaggugaccgugcug

SEQ ID NO: 32067 - RNA, 333 nt, Artificial Sequence
  derived and/or modified sequence opt4 from anti-HIV-1_LightChain
cagagcgugcugacccagccccccagcgugagcgccgcccccggccagaccgugaccaucagcugcagcggcagcagcagcaacaucggcagcaacaccgugaacugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32068 - RNA, 336 nt, Artificial Sequence
  derived and/or modified sequence opt4 from anti-HIV-1_LightChain
cagagcgugcugacccagccccccagcgugagcggcgcccccggccagagagugaccaucuucugcaccggcagcagcagcaacgugggcggcggcuacgacgugcacugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32069 - RNA, 333 nt, Artificial Sequence
  derived and/or modified sequence opt4 from anti-HIV-1_LightChain
cagagcgugcugacccagccccccagcgugagcgccgcccccggccagaaggugacccugagcugcagcggcagcagcagcaacaucggcaacaacagcgugagcugguaccagcaguuccccggcaccgcccccaagcugcugaucuacgacagcgacaagagacccagcggcauccccgacagauucagcggcagcaagagcggcaccagcgccacccugggcaucaccggccugcagaccggcgacgagggcgacuacuacugcggcaccugggacagaagccugagcgccggcggcguguucggcaccggcaccaaggugaccgugcug

SEQ ID NO: 32070 - RNA, 333 nt, Artificial Sequence
  derived and/or modified sequence opt4 from anti-HIV-1_LightChain
cagagcgugcugacccagccccccagcgccagcggcacccccggccagaaggugaccaucagcugcagcggcagcagcagccagaucggcagcaacagcguguacugguaccagcagcugcccggcaccacccccaagcugcugaucuacggcaacaaccagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32071 - RNA, 336 nt, Artificial Sequence
  derived and/or modified sequence opt4 from anti-HIV-1_LightChain
cagagcgcccugacccagcccgccagcgugagcggcagccccggccagagcaucaccaucagcugcaccggcaccggcagcgacgugggcggcuacaaccacgugagcugguaccagcagcaccccggcaaggcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32072 - RNA, 333 nt, Artificial Sequence
  derived and/or modified sequence opt4 from anti-HIV-1_LightChain
cagagcgugcugacccagccccccagcgugagcgccgcccccggccagagagugaccaucagcugcagcggcagcggcagcaacaucggcgacagauucgugagcugguaccagcaccugcccggcaccgugcccaagcugcugaucuacgacaacgagcacagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32073 - RNA, 333 nt, Artificial Sequence
  derived and/or modified sequence opt4 from anti-HIV-1_LightChain
cagagcgugcugacccagccccccagcgugagcgccgcccccggccagaagaucaccaucagcugcagcggcagcagcagcaacaucggcaagagcguggugagcugguacagacaguuccccggcaccgcccccaagcugcugaucuacgacaccuacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32074 - RNA, 333 nt, Artificial Sequence
  derived and/or modified sequence opt4 from anti-HIV-1_LightChain
cagcccgugcugacccagccccccagcgccagcggcacccccggccagagagugaccaucagcugcagcggcagcagcagcaacaucggcggcaacaccgugaacugguaccagcaguuccccggcgccgcccccagacugcugaucuacgaggacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32075 - RNA, 333 nt, Artificial Sequence
  derived and/or modified sequence opt4 from anti-HIV-1_LightChain
aacuucaugcugacccagccccacagcgugagcgagagccccggcaagaccgugaccaucagcugcaccagaagcagcggcagcguggccagcaacuacgugcagugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32076 - RNA, 333 nt, Artificial Sequence
  derived and/or modified sequence opt4 from anti-HIV-1_LightChain
cagagcaugcugacccagccccccagcgugagcgccgcccccggccagagagugaccgugagcugcagcggcagcagcagcaacaucggcagccacuucgugagcugguaccagcagcugcccggcaccgcccccaagcugcugaucuacgacaacagcaacagacccagcgccauccccgacagauucagcggcagcaagagcggcaccagcgccacccugggcaucagcggccugcacaccggcgacgaggccgacuacuacugcgccaccugggacaacagccugagcaccggcggcguguucggcaccggcaccaaggugaccgugcug

SEQ ID NO: 32077 - RNA, 333 nt, Artificial Sequence
  derived and/or modified sequence opt4 from anti-HIV-1_LightChain
cagagcgugcugacccagccccccagcgugagcgccgcccccggccagaaggugaucaucagcugcagcggcggcagcagcaacaucggcaacaacuucgugagcugguaccaccagcugcccggcaccgcccccaagcugcugaucuacgagaacaccaagagacccagcaagauccccgccagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32078 - RNA, 315 nt, Artificial Sequence
  derived and/or modified sequence opt4 from anti-HIV-1_LightChain
cagagccugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggc

SEQ ID NO: 32079 - RNA, 336 nt, Artificial Sequence
  derived and/or modified sequence opt4 from anti-HIV-1_LightChain
cagagcgcccugacccagcccgccagcgugagcggcagccccggccagagcaucaccaucagcugcaccggcaccagcagcgacaucggcagcuacagcuucgugagcugguaccagcagcaccccggcaaggcccccaagcugaucaucuacgacgugaacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32080 - RNA, 336 nt, Artificial Sequence
  derived and/or modified sequence opt4 from anti-HIV-1_LightChain
cagagcgugcugacccagccccccagcgugagcggcgcccccggccagagagugaccaucagcugcaccggcaacagcagcaacaucggcgccggcuucgacgugcacugguacagacaccugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32081 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcggcagcagcaacaucggcaacuacuacgugagcugguaccugcagcugcccggcgccgcccccaagcugcugaucuacgacaccgacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32082 - RNA, 333 nt, Artificial Sequence
  derived and/or modified sequence opt4 from anti-HIV-1_LightChain
cagagcgugcugaccagaccccccagcgugagcgccgcccccggccagaaggugaccaucagcugcagcggcagaagcagcaacaucggcaacaacuacgugagcugguaccagcagcugcccggcgccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32083 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcaccaucagcaacaucggcgccaaccuggugagcugguacagacagcugcccggcaccgugcccaccgugcugauccacgagaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32084 - RNA, 327 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcaacaacuucgugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugacc

SEQ ID NO: 32085 - RNA, 333 nt, Artificial Sequence
  derived and/or modified sequence opt4 from anti-HIV-1_LightChain
cagagcgugcugacccagagccccagcgugagcgccgcccccggccagagagugaccaucagcugcagcggcggcagcagcaacaucggcagcaacgccgugagcugguaccagcagcugcccggcaccgcccccaagcugcugaucuacggcgacaccaugagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32086 - RNA, 333 nt, Artificial Sequence
  derived and/or modified sequence opt4 from anti-HIV-1_LightChain
cagagcgugcugacccagccccccagcgugagcgccgcccccggccagcaggugaccaucagcugcagcggcaccaccagcaacaucggcaccaacuacgugagcugguaccagcagaugccccccgccgcccccaagcugcugaucuacgacaacaagaagagacccagcgacauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32087 - RNA, 333 nt, Artificial Sequence
  derived and/or modified sequence opt4 from anti-HIV-1_LightChain
cagagcguggugacccagagccccagcgccagcggcacccccggccagagagugaucaucagcugcagcggcagcagcagcaacaucggcaacaucuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32088 - RNA, 333 nt, Artificial Sequence
  derived and/or modified sequence opt4 from anti-HIV-1_LightChain
cagagcgugcugacccagccccccagcaugagcgccgcccccggccagaaggugaccaucagcugcagcggcagcaccagcaucaucggcaacaacuacaucagcugguaccagcagcugcccggcaccgcccccaagcugcugaucuacgaggacaacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32089 - RNA, 336 nt, Artificial Sequence
  derived and/or modified sequence opt4 from anti-HIV-1_LightChain
cagagcgcccugacccagccccccagcgccagcggcagcagaggccagagcgugaucaucagcugcaccggcaccagcagcgacgugggcguguacaaccuggugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32090 - RNA, 333 nt, Artificial Sequence
  derived and/or modified sequence opt4 from anti-HIV-1_LightChain
cagagcgugcugacccagccccccagcaugagcgccgcccccggccagagcgugagcaucagcugcagcggcagcagcgacaacaucgagagaaaccaggugaucuggcugagacaggugcccggcgccgcccccaccgugcugaucaucuucaacaacagaagacccagcggcgugcccgacagauucagcggcagcagaagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32091 - RNA, 333 nt, Artificial Sequence
  derived and/or modified sequence opt4 from anti-HIV-1_LightChain
cagagcgugcugacccagccccccagcgugagcgccgcccccggccagaccgugaccaucagcugcagcggcagcuucagcaacaucgagaccaacuacgugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32092 - RNA, 333 nt, Artificial Sequence
  derived and/or modified sequence opt4 from anti-HIV-1_LightChain
cagagccugcugacccagccccccagcgugagcgccgcccccggccagaaggugaccaucagcugcagcggcagcagcagcaacaucggcagcaaguacgugugcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32093 - RNA, 336 nt, Artificial Sequence
  derived and/or modified sequence opt4 from anti-HIV-1_LightChain
cagagcgcccugacccagcccagaagcgugagcggcagccccggccagagcgugaccaucagcugcaccggcaccaccagcgacgugggcggcuacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32094 - RNA, 333 nt, Artificial Sequence
  derived and/or modified sequence opt4 from anti-HIV-1_LightChain
cagagcgugcugacccagccccccagcgugagcgccgcccccggccagagagugaccaucagcugcaccggcuucaccagcaacaucggccugaacuacgugagcugguaccagcaggugcccggcaccacccccaagcuggugaucuucgagaacgacagaagauuccugggcauccccgacagauucagcggcagcaagagcggcgccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32095 - RNA, 333 nt, Artificial Sequence
  derived and/or modified sequence opt4 from anti-HIV-1_LightChain
cagagcgugcuggcccagccccccagcgugagcgccgcccccggccagaaggugaccaucagcugcagcggcagaaccagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 32096 - RNA, 333 nt, Artificial Sequence
  derived and/or modified sequence opt4 from anti-HIV-1_LightChain
cagagcgugcugacccagcccaccagcgugagcgccgcccccggcagaugggugaccgugagcugcagcggcaccagaagcaacaucggcgaccacagcgugagcugguuccagcaccugcccggcgccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcaccggcggcguguucggcaccggcaccaaggugaccgugcug

SEQ ID NO: 32097 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcgacaacuacgugagcugguaccagcaguuccccggcaccgcccccaagcugcugaucagcgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32098 - RNA, 333 nt, Artificial Sequence
  derived and/or modified sequence opt4 from anti-HIV-1_LightChain
caggcccugcugacccagccccccagcgugagcgccgcccccggccagaaggugaccaucagcugcagcggcagcagcagcaacaucggcaacaacuacgugagcugguaccagcagcugcccggcaccgcccccaagcugcugaucagcgagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 32099 - RNA, 333 nt, Artificial Sequence
  derived and/or modified sequence opt4 from anti-HIV-1_LightChain
cagcuggugcugacccagccccccagcgccagcggcacccccggccagagagugaccaucagcugcagcggcagcaccagcaacaucggcaccuacuacguguacugguaccagcugcugcccggcaccacccccaaggugcugaucuacgccaacgaccagagacccagcggcauccccgacagauucagcggcagcaagagcggcaccagcgccacccugggcaucaccggccugcagaccggcgacgaggccgacuacuacugcggcaccugggacagcagccugagcaccggcggcguguucggcaccggcaccaaggugaccgugcug

SEQ ID NO: 32100 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcaccagcagcaacaucggcaacaacuucgugagcugguaccagagacugcccggcaccgcccccaagcugcugaucuucgagaacgacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32101 - RNA, 333 nt, Artificial Sequence
  derived and/or modified sequence opt4 from anti-HIV-1_LightChain
cagagcgugcugacccagagccccagcgugagcgccacccccggccagagagugaccaucagcugcagcggcaacaccagcaacaucggcaagaacuucgugagcugguaccagcaguuccccggcaccgcccccaagcugcugaucuacgacaacgacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32102 - RNA, 333 nt, Artificial Sequence
  derived and/or modified sequence opt4 from anti-HIV-1_LightChain
cagagcgugcugacccagccccccagcgugagcgccgcccccggcagagaggugaucaucagcugcagcggcagcagcagcaacaucggcaacaaccacgugagcugguaccagcagcugcccggcaccgcccccaaggugcugaucuacgagagcaacaagagacacagcggcauccccgacagauucagcggcagcaagagcggcaccagcgccacccuggccaucaccggccugcagaccggcgacgaggccgacuacuacugcggcgccugggacagcagccugagcgccggcggcguguucggcaccggcaccaaggugaccgugcug

SEQ ID NO: 32103 - RNA, 333 nt, Artificial Sequence
  derived and/or modified sequence opt4 from anti-HIV-1_LightChain
cagagcgugcugacccagccccccagcgccagcggcacccccggccagagagugaccaucagcugcagcggcagcagcagcaacaucggcgacagcaccgugaacugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32104 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcaccagcaacaucggcaacaacuacgugagcugguaccagcagcugcccggcaccgcccccaagcugcugaucuacgagaacaacagacagcccagcggcauccccgacagauucagcggcagcaagagcggcaccagcgccacccugggcaucaccggccugcagaccggcgacgagggcgacuacuacugcggcaccugggacagaagccugagcgccggcggcguguucggcaccggcaccaaggugaccgugcug

SEQ ID NO: 32105 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcagcaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccguguacuacugcggcaccugggacagcagccugaccgccggcggcguguucggcagcggcaccaaggugaccgugcug

SEQ ID NO: 32106 - RNA, 336 nt, Artificial Sequence
  derived and/or modified sequence opt4 from anti-HIV-1_LightChain
cagagcgugcugacccagccccccagcgugagcggcgcccccggccagagagugaccaucagcugcaucggcagcagcagcaacaucggcgccgacuacagagugcacugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcaccggcggcguguucggcaccggcaccaaggugaccgugcug

SEQ ID NO: 32107 - RNA, 336 nt, Artificial Sequence
  derived and/or modified sequence opt4 from anti-HIV-1_LightChain
cagagcgugcugacccagccccccagcgugagcggcgcccccggccagagaaucaccgugagcugcaccggcaccagcagcaacaucggcgcccccuacgacgugaacugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32108 - RNA, 333 nt, Artificial Sequence
  derived and/or modified sequence opt4 from anti-HIV-1_LightChain
cagagcgugcugacccagccccccgccaugagcgccgcccccggccagagcgugaccaucagcugcagcggcagcgccuucaacaucgagagacaccaggugaccuggcugagacaccugcccggcaccgcccccaccagcgugaucaucaugaacaaccagagacccagcggcgugcccgacagauucagcggcagcagaagcggcaccagcgccacccugggcaucaccggccugcagaccggcgacgagggcgacuacuacugcggcaccugggacagaagccugagcgccggcggcguguucggcaccggcaccaaggugaccgugcug

SEQ ID NO: 32109 - RNA, 333 nt, Artificial Sequence
  derived and/or modified sequence opt4 from anti-HIV-1_LightChain
cagagcgugcuggcccagccccccagcgccagcggcacccccggccagagagugaccaucagcugcagcggcagcgccagcaacaucggcuucaacagcgugaccugguaccagcagcugcccggcaccgcccccaccgugcugaucuacggcaacgaccugagacccagcggcauccccgacagauucagcggcagcaagagcggcaccagcgccacccugggcaucaccggccugcagaccggcgacgagggcgacuacuacugcggcaccugggacagaagccugagcgccggcggcguguucggcaccggcaccaaggugaccgugcug

SEQ ID NO: 32110 - RNA, 336 nt, Artificial Sequence
  derived and/or modified sequence opt4 from anti-HIV-1_LightChain
cagagcgcccugacccagcccgccagcgugagcggcagccccggcgagagcaucaccaucagcugcaccggcaccagaagcgacaucggcaacuacgccuacgugagcugguaccagcagcugcccggcaccgcccccaagcugcugaucagcgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32111 - RNA, 333 nt, Artificial Sequence
  derived and/or modified sequence opt4 from anti-HIV-1_LightChain
cagagcgugcugacccagccccccagcgugagcgccccccccggccagaaggugaccaucagcugcagcggcaccaccagcaacaucggcagcaacuacguggccugguaccagcagcugcccggcaccgcccccaagcugcugaucuacgacaacgacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32112 - RNA, 333 nt, Artificial Sequence
  derived and/or modified sequence opt4 from anti-HIV-1_LightChain
cagagcgugcugacccagagccccagcgugagcggcacccccggccagagagugaccaucuucugcagcggcagcgacagcgacaucggcaucaacagcgugagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32113 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcaacagcagcaacaucggcaacaacuacgugagcugguaccagcaccugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32114 - RNA, 333 nt, Artificial Sequence
  derived and/or modified sequence opt4 from anti-HIV-1_LightChain
cagagccugcugacccagccccccagcgugagcgccgcccccggccagaaggugaccaucagcugcagcggcggcaacagcgacaucggcaagaacuucgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32115 - RNA, 333 nt, Artificial Sequence
  derived and/or modified sequence opt4 from anti-HIV-1_LightChain
cagagcgugcugacccagccccccagcgugagcgccgcccccggccagaaggugaucaucagcugcagcggcagcagcagcaacaucggcaagaacuacguggccugguaccagcagcugcccggcaccgcccccaagcugcugguguacgagaacaccaacagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32116 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcaugagcgacaucggccugaaccccgugagcugguacagacagcugcccgaggcccccccccaccugcugaucuucgacaacgacgagagacccagcggcaccgccggcagauucagcgccagcaagagcggcaccagcgccacccuggacaucaccggccugcagaccggcgacgaggccgacuacuacugcggcaccugggacagcagccugagcgccggcggcguguucggcaccggcaccaaggugaccgugcug

SEQ ID NO: 32117 - RNA, 336 nt, Artificial Sequence
  derived and/or modified sequence opt4 from anti-HIV-1_LightChain
cagagcgcccugacccagcccgccagcgugagcggcagccccggccagagcaucaccaucagcugcaccggcaccagcagcgacgugggcagcuacaaccuggugagcugguaccagcaguaccccggcagagcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32118 - RNA, 333 nt, Artificial Sequence
  derived and/or modified sequence opt4 from anti-HIV-1_LightChain
cagagccugcugacccagccccccagcgugagcgccagccccggccagaaggugaccaucagcugcagcggcaccagcagcaacaucggcaacaacuacgugagcugguaccagcaguuccccggcaccgcccccaagcugcugaucuacgagaacaacaagagaagcagcggcauccccgacagauucagcggcagcaagagcgacaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32119 - RNA, 336 nt, Artificial Sequence
  derived and/or modified sequence opt4 from anti-HIV-1_LightChain
cagagcgugcugacccagccccccagcgugagcggcgcccccggccagagagugaccaucagcugcaccggcagaagaagcaacaucggcgccggcuacgacgugcacugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 32120 - RNA, 333 nt, Artificial Sequence
  derived and/or modified sequence opt4 from anti-HIV-1_LightChain
cagagcgugcugacccagccccccagcgugagcgccgcccccggccagagagugaccaucagcugcagcggcagcagcagcaacaucggcaacaacuucgugagcugguaccaguucuuccccggcaccgcccccaagcuggugaucuacgagaacgacaagagacccagcggcacccccgacagauucagcggcagcaagagcggcaccagcgccacccuggccaucaucggccugcagaccggcgacgagggcgacuacuacugcggcaccugggacaacagccugagcaccggcggcguguucggcaccggcaccaaggugaccgugcug

SEQ ID NO: 32121 - RNA, 333 nt, Artificial Sequence
  derived and/or modified sequence opt4 from anti-HIV-1_LightChain
cagagcgugcugacccagccccccagcgugagcgccgcccccggccagagagugaccaucagcugcagcggcggcagcagcaacaucggcaacaaccacgugagcugguaccagcagcugcccggcaccgcccccaagcugcugaucagcgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32122 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcagagacuucgugagcugguaccagcaggugcccggcaccgcccccaagcugcugaucuacgacaacgacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32123 - RNA, 336 nt, Artificial Sequence
  derived and/or modified sequence opt4 from anti-HIV-1_LightChain
cagaccguggugacccagccccccagcgugagcggcgcccccggccagaccgccaccaucagcugcaccggcagcagcagcaacaucggcgccgacuacgacgugcacugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32124 - RNA, 333 nt, Artificial Sequence
  derived and/or modified sequence opt4 from anti-HIV-1_LightChain
aacuucaugcugacccagccccccagcgccagcggcacccccggccagagagugaccaucagcugcagcggcagcagcagcaacaucggcagcaacuacguguacugguaccagcagcugcccggcaccacccccaagcugcugaucuacagaaacaaccagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32125 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagccccaacaucggcaacaacuuccugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32126 - RNA, 333 nt, Artificial Sequence
  derived and/or modified sequence opt4 from anti-HIV-1_LightChain
cagagcgugcugacccagagccccagcgugagcgccgcccccggccagaaggugaccaucagcugcagcggcagcagcagcgacaucggcaacaacuucgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32127 - RNA, 333 nt, Artificial Sequence
  derived and/or modified sequence opt4 from anti-HIV-1_LightChain
caguucuuccugacccagccccccagccugagcgccacccccggccagagagugagcaucagcugcagcggcggcggcagcaacaucgccaacaacgacguguucugguuccagcaguuccccggcgccggccccagacugcugaucuacgacaaccugaagagacacuacggcacccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32128 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcggccccaacaucggcagcaacagcgugagcugguaccagcacuuccccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32129 - RNA, 333 nt, Artificial Sequence
  derived and/or modified sequence opt4 from anti-HIV-1_LightChain
cagagcgugcugacccagagccccagcgccagcggcacccccggccagagagugaccaucagcugcagcggcagcagcagcaacaucggcagcaacaccgugagcugguuccagcaccugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32130 - RNA, 333 nt, Artificial Sequence
  derived and/or modified sequence opt4 from anti-HIV-1_LightChain
cagagcgugcugacccagccccccagcgugagcggcgcccccggccagaacgugaucaucagcugcagcggcagcagcagcaacaucggcaagaacuacguggccugguaccagcagcugcccggcaccgcccccaagaucgugaucuacgagaccaccaacagacccagcggcauccccgccagauucagcggcagcaagagcggcaccagcgccacccugggcaucaccggccugcaggccggcgacgaggccgacuacuacugcggcaccugggacagcagccugaacgccggcggcguguucggcaccggcaccaaggugaccgugcug

SEQ ID NO: 32131 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcaacaacuuccugagcugguaccagcaccugcccggcaccgcccccagacugcugaucuacgacaacgaccagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32132 - RNA, 333 nt, Artificial Sequence
  derived and/or modified sequence opt4 from anti-HIV-1_LightChain
cagagcgugcugacccagccccccagcgccagcggcacccccggccagaaggugaccaucagcugcagcggcagcagcagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcaccggcggcguguucggcaccggcaccaaggugaccgugcug

SEQ ID NO: 32133 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcaccaccagcaacaucggcaaccacuacgugagcugguaccagcaguuccccggcaccgcccccaagcugaucaucuacgagaccgacagaagacccagcggcauccccgccagauucagcggcagcaagagcggcaccagcgccacccuggccaucgccggccugcagaccggcgacgaggccgacuacuacugcggcaccugggacagcagccugagcaccggcggcguguucggcaccggcaccaaggugaccgugcug

SEQ ID NO: 32134 - RNA, 333 nt, Artificial Sequence
  derived and/or modified sequence opt4 from anti-HIV-1_LightChain
cagcuggugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcaccggcggcguguucggcaccggcaccaaggugaccgugcug

SEQ ID NO: 32135 - RNA, 333 nt, Artificial Sequence
  derived and/or modified sequence opt4 from anti-HIV-1_LightChain
cagagcgugcugacccagccccccagcgugagcgccgcccccggccagagagugaccaucagcugcagcggcggcagcagcaacaucggcaacaaccacgugagcugguaccagcaccugcccggcagagccccccagcugcugaucuacgacaccacccagagacccagcagaauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32136 - RNA, 333 nt, Artificial Sequence
  derived and/or modified sequence opt4 from anti-HIV-1_LightChain
cagagcgugcugacccagccccccagcgugagcgccgcccccggccagaagaucaccaucagcugcagcggcagcagaagcaacaucggcaacaacuacgugagcugguaccagcaguuccccggcaccgcccccaagcugcugaucuacgacaacaaccagagacccagcagaauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32137 - RNA, 321 nt, Artificial Sequence
  derived and/or modified sequence opt4 from anti-HIV-1_LightChain
cagagcgugcugacccagccccccagcgugagcgccgcccccggccagagagugaccaucagcugcuucggcagcagauucagcagcgugagcugguaccagcagcugcccggcaccgcccccaagcugcugaucuaccccaacggcgagagacccagcggcauccccgacagauucuucggcagcgagagcggcaccagcgccacccugggcaucaccggccugcagaccggcgacgaggccgacuacuacugcgccaccugggacagcagccugagcgccggcggcguguucggcaccggcaccaagcugaccgugcug

SEQ ID NO: 32138 - RNA, 333 nt, Artificial Sequence
  derived and/or modified sequence opt4 from anti-HIV-1_LightChain
cagagcgugcugacccagccccccagccugagcgccgcccccggccagaaggugaccaucagcugcagcggcagcagccugaacaucggcaaccacuacgugagcugguaccagcaggugcccggcaccgcccccaagcugcugaucuacgaggacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32139 - RNA, 333 nt, Artificial Sequence
  derived and/or modified sequence opt4 from anti-HIV-1_LightChain
caguucgugcugacccagccccccagcgugagcgccgcccccggccagaaggugaccgugagcugcagcggcaccaccagcgacaucggcgagaacuacgugagcugguaccagaaguuccccgaggccgcccccaagcugcugaucuacgacaacgacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32140 - RNA, 333 nt, Artificial Sequence
  derived and/or modified sequence opt4 from anti-HIV-1_LightChain
cugagcgugcugacccagccccccagcgugagcgccgcccccggccagcaggugaccaucagcugcagcggcaccaccagcaacaucggcaccaacuacgugagcugguaccagcagaugccccccaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32141 - RNA, 336 nt, Artificial Sequence
  derived and/or modified sequence opt4 from anti-HIV-1_LightChain
cagagcaugcugacccagccccccagcgugagcggcgcccccggccagagagugaccaucagcugcaccggcagcagaagcaacaucggcgccggcuacgacgugcacugguaccugcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32142 - RNA, 333 nt, Artificial Sequence
  derived and/or modified sequence opt4 from anti-HIV-1_LightChain
cagagcgugcugacccagccccccagcgugagcgccacccccggccagaaggugaccaucagcugcagcggcagcagaagcaacaucggcagccacuacgugagcugguaccagcaguuccccgagagcgcccccacccugcugaucuacgagaacguggagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32143 - RNA, 333 nt, Artificial Sequence
  derived and/or modified sequence opt4 from anti-HIV-1_LightChain
caguucuuccugacccagccccccagccugagcgccacccccggccagagagugagcaucagcugcagcggcggcggcagcaacaucgccaacaacgacguguucugguuccagcaguuccccggcgccggccccagacugcugaucuacgacaaccugaagagacacuacggcacccccgacagauucagcggcagcaagagcggcgccaccggcacccuggagaucaccgaggugcagaccgccgacgaggccgacuacuacugcggcaccugggacagcagccugagcgccggcggcguguucggcaccggcaccaaggugaccgugcug

SEQ ID NO: 32144 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcggcagcagcaacaucggcgacaacagcgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcaccggcggcguguucggcaccggcaccaaggugaccgugcug

SEQ ID NO: 32145 - RNA, 333 nt, Artificial Sequence
  derived and/or modified sequence opt4 from anti-HIV-1_LightChain
cagagcgugcugacccagccccccagcgugagcgccgcccccggccagaccgugaccaucagcugcagcggcagcgccagcaacaucggcagaaacagcgugagcugguaccaguacgugcccggcgccgcccccaagagacugaucuacgagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 32146 - RNA, 333 nt, Artificial Sequence
  derived and/or modified sequence opt4 from anti-HIV-1_LightChain
cagagcgugcuggcccagccccccagcgugagcgccgcccccggccagaaggugaccaucagcugcagcggcagaaccagcaacaucggcaacuacuucgugagcugguaccagcaguuccccggcaccgcccccagacugcugaucuacgacaacgaccagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32147 - RNA, 333 nt, Artificial Sequence
  derived and/or modified sequence opt4 from anti-HIV-1_LightChain
cagagcgcccugacccagcccgccagcgugagcgccgcccccggccagaaggugaccaucagcugcagcggcagcagcagcaacaucggcaacaucuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32148 - RNA, 333 nt, Artificial Sequence
  derived and/or modified sequence opt4 from anti-HIV-1_LightChain
cagagcgugcugacccagccccccagcgugagcgccacccccggccagagagugaccgugagcugcagcggcagcagcagcaacaucggcaaccacuacgugagcugguaccagcaggugcccggcaccgcccccaagcugcugaucuacgacaacagcaacagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32149 - RNA, 333 nt, Artificial Sequence
  derived and/or modified sequence opt4 from anti-HIV-1_LightChain
cagagcgugcugacccagccccccagccugagcgccgcccccggccagagagugaccgugagcugcagcggcagcagcagcaacaucggcgacaacuacgugagcugguaccagcagcugcccggcgccgcccccagacugcugaucuacgacaacagcaucagacccagcgccauccccgccagauucagcggcagcaagagcggcaccagcgccacccuggccaucaccggccugcagaccggcgacgaggccgacuacuacugcggcaccugggacagcagccugagcgccggcggcguguucggcaccggcaccaaggugaccgugcug

SEQ ID NO: 32150 - RNA, 336 nt, Artificial Sequence
  derived and/or modified sequence opt4 from anti-HIV-1_LightChain
cagagcgcccugacccagcccgccagcgugagcggcagccccggccagagcaucaccaucagcugcaccggcaccagcagcgacgugggcggcuacgacuacgugagcugguaccugcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32151 - RNA, 333 nt, Artificial Sequence
  derived and/or modified sequence opt4 from anti-HIV-1_LightChain
cagagcgugcugacccagccccccagcgugagcgccgcccccggccagagagugaccgugagcugcagcggcagcagcagcaacaucggcaacaacuacgugagcugguaccagcaguuccccggcaccgcccccaagcuggugaucuacgacaccgacaagagacccagcggcauccccgacagauucagcggcagcaagagcggcaccagcgccacccugggcaucaccggccugcagaccggcgacgaggccgacuacuacugcgccaccugggacagcagccugagcgccggcggcguguucggcaccggcaccaaggugaccgugcug

SEQ ID NO: 32152 - RNA, 336 nt, Artificial Sequence
  derived and/or modified sequence opt4 from anti-HIV-1_LightChain
cagagcgugcugacccagccccccagcgugagcggcgcccccggccagagagugaccaucagcugcaccggcaacagcagcaacaucggcgccggcuacgacgugcacugguaccagcagcugcccggcaccgcccccaagcugcugaucagcgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32153 - RNA, 333 nt, Artificial Sequence
  derived and/or modified sequence opt4 from anti-HIV-1_LightChain
cagagcgugcugacccagccccccagcgccagcggcacccccggccagagagugaccaucagcugcagcggcagcagcagcaacaucggcagcaacuacguggacugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32154 - RNA, 333 nt, Artificial Sequence
  derived and/or modified sequence opt4 from anti-HIV-1_LightChain
cagagcgugcugacccagccccccagcgugagcgccacccccggccagaccgugaccaucagcugcagcggcagcagcagcaacaucggcaacaacuaccugagcugguacagacagcugcccagaaccgcccccaagcugcugaucuacgagaacaacagaagacccagcggcgugcccgccagauucagcggcagcaagagcggcaccagcgccacccuggccaucaccggccugcagaccggcgacgaggccgacuacuacugcggcaccugggacagcagccugagcgccggcggcguguucggcaccggcaccaaggugaccgugcug

SEQ ID NO: 32155 - RNA, 321 nt, Artificial Sequence
  derived and/or modified sequence opt4 from anti-HIV-1_LightChain
cagagcgugcugacccagccccccagcgugagcgccgcccccggccagagagugaccaucagcugcuucggcagcagauucagcagcgugagcugguaccagcagcugcccggcaccgcccccaagcugcugaucuaccccaacggcgagagacccagcggcauccccgacagauucuucggcagcgagagcggcaccagcgccacccugggcaucaccgccgugcagaccggcgacgaggccgacuacuacugcggcaccugggacgacagccugagcaccggcggcguguucggcaccggcaccaaggugaccgugcug

SEQ ID NO: 32156 - RNA, 333 nt, Artificial Sequence
  derived and/or modified sequence opt4 from anti-HIV-1_LightChain
cagagcgugcugacccagccccccagcgugagcgccgcccccggccagaaggugacccugagcugcagcggcaccagcagcaacaucggcaacaacuacgugagcugguaccagcaggugcccggcgccgcccccaaggugcugaucuacgagaacgacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32157 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcaacagcaacaucggcaacaacuacgugagcugguaccagcagcugcccggcaccgccaccaagcugcugaucuacgagaacgacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32158 - RNA, 333 nt, Artificial Sequence
  derived and/or modified sequence opt4 from anti-HIV-1_LightChain
cagagcgugcugacccagccccccagccugagcgccgcccccggccagcaggugagcaucagcugccugggcagaagcagcaacaucggcaccaacuacgugagcugguaccagcaguuccccggcaccgcccccaagcugcugaucuacgagaacaagaagagacccagcgagauccccgacagauucagcggcagcaagagcggcaccagcgccacccugggcaucaccggccugcagcccggcgacgaggccgacuacuacugcggcaccugggacagcagccugagcgccggcggcguguucggcaccggcaccaaggugaccgugcug

SEQ ID NO: 32159 - RNA, 336 nt, Artificial Sequence
  derived and/or modified sequence opt4 from anti-HIV-1_LightChain
cagagcgcccugacccagccccccagcgccagcggcagccccggccagagcgugaccaucagcugcaccggcaccagcagcgacgugggcgccuacaacagcgugagcugguaccagcagcugcccggcaccgcccccaagcugcugaucagcgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32160 - RNA, 333 nt, Artificial Sequence
  derived and/or modified sequence opt4 from anti-HIV-1_LightChain
cagagcgcccugacccagccccccagcgccagcggcagccccggccagagcgugaccaucagcugcagcggcggcagcagcaacaucggcaacaaccacgugagcugguaccagcaccugcccggcagagccccccagcugcugaucuacgacaccacccagagacccagcagaauccccgacagauucagcggcagcagaagcggcaccagcgccacccuggccaucaccggccugcagaccggcgacgaggccguguacuacugcggcaccugggacaacagccugagcaccggcggcguguucggcaccggcaccaaggugaccgugcug

SEQ ID NO: 32161 - RNA, 333 nt, Artificial Sequence
  derived and/or modified sequence opt4 from anti-HIV-1_LightChain
cagagcgugcugacccagccccccagcgugagcgccgcccccggccagagagugaccaucagcugcagcggcggcaccagcaacaucggcaacgaguacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32162 - RNA, 333 nt, Artificial Sequence
  derived and/or modified sequence opt4 from anti-HIV-1_LightChain
cagagcgugcugacccagccccccagcgugagcgccgcccccggccagagagugaccgugagcugcagcggcagcagcagcaacaucggcaacaacuacgugagcugguaccagcagcugcccggcgccgcccccaagcugcugaucuacgacaccgacaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32163 - RNA, 333 nt, Artificial Sequence
  derived and/or modified sequence opt4 from anti-HIV-1_LightChain
cagagccugcugacccagccccccagcgugagcgccgcccccggccagaaggugaccaucagcugcagcggcggcaacagcgacaucggcaagaacuucgugagcugguaccagcagagccccggcgccgcccccagacugcugaucuacgagaacgacagaagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32164 - RNA, 333 nt, Artificial Sequence
  derived and/or modified sequence opt4 from anti-HIV-1_LightChain
cagagcgugcugacccagccccccagcgugagcgccgcccccggccagaaggugaacaucagcugcagcggcagcagcagcaacaucggcaagaacuacgugagcugguaccagcagauccccggcaccgcccccaaggugcugaucuacgagaacaacaagagacccagcggcauccccgacagauucagcggcagcaagagcggcaccagcgccacccugggcaucgccggccugcagaccggcgacgaggccgacuacuacugcgccaccugggacagcagccugagcgccggcggcguguucggcaccggcaccaaggugaccgugcug

SEQ ID NO: 32165 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcaacagacacgugagcugguaccagcagcugcccggcaccgugcccaagcugcugaucuacgagaccaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32166 - RNA, 336 nt, Artificial Sequence
  derived and/or modified sequence opt4 from anti-HIV-1_LightChain
cagagcgugcugacccagccccccagcgugagcggcgcccccggccagagagugaccaucagcugcaccggcagcagcagcaacaucggcgccggcuacgacgugcacugguaccagcagcugcccggcaccgcccccaagcugcugaucuucggccacgacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32167 - RNA, 333 nt, Artificial Sequence
  derived and/or modified sequence opt4 from anti-HIV-1_LightChain
cagagcgugcugacccagcugcccagcgccagcggccugcccggccagaccgugaccaucagcugcagcggcagcaccagcagcaucggcagcaaccacguguacugguaccagcagguggccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcgccaccugggacagcagccugagcgccggcggcguguucggcaccggcaccaaggugaccgugcug

SEQ ID NO: 32168 - RNA, 333 nt, Artificial Sequence
  derived and/or modified sequence opt4 from anti-HIV-1_LightChain
cagagcgugcugacccagacccccagcgccagcggcgcccccggccagggcgugaccaucagcugcagcggcagcagcagcaacgugggcagaaacuacgugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32169 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcaacaacuacgugagcugguaccagcaguuccccggcaccgcccccaagcugcugaucagcgacaacaacaagagacccagcggcauccccgacagauucagcgugagcaagagcggcaccagcgccacccugggcaucaccggccugcaggccggcgacgaggccgacuacuacugcggcaccugggacagcagccugagcgccggcggcguguucggcaccggcaccaaggugaccgugcug

SEQ ID NO: 32170 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcaacagcaacaucggcaacaacuacgugaccugguaccagcaguuccccggcaccgcccccaaggugcugaucuacgacaacagcagaagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 32171 - RNA, 333 nt, Artificial Sequence
  derived and/or modified sequence opt4 from anti-HIV-1_LightChain
cagagcgugcugacccagccccccagcgugagcggcgcccccggccagagagugaccaucagcugcagcggcagcagcagcaacaucggcaacaacuacgugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32172 - RNA, 333 nt, Artificial Sequence
  derived and/or modified sequence opt4 from anti-HIV-1_LightChain
cagagcgugcugacccagccccccagcgugagcgccgcccccggccagaccgugaccaucagcugcagcggcagcaccagcaacaucggccagaacuuccugagcugguuccagcacgugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32173 - RNA, 333 nt, Artificial Sequence
  derived and/or modified sequence opt4 from anti-HIV-1_LightChain
aacuucaugcugacccagccccccagcgccagcggcacccccggccagagagugaccaucagcugcagcggcagcagcagcaacaucggcagcaaguacgugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32174 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcaacaacuacgugagcugguaccagcugcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaacagccugagcaccggcggcguguucggcaccggcaccaaggugaccgugcug

SEQ ID NO: 32175 - RNA, 333 nt, Artificial Sequence
  derived and/or modified sequence opt4 from anti-HIV-1_LightChain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagaucaucaucuacgacaacaacaagagacccagcggcauccccgacagauucagcggcagcaagagcggcaccagcgccacccugggcaucaccggccugcagaccggcgacgaggccgacuacuacugcggcaccuggcacagcagccugagcgccggcggcguguucggcaccggcaccaaggugaccgugcug

SEQ ID NO: 32176 - RNA, 333 nt, Artificial Sequence
  derived and/or modified sequence opt4 from anti-HIV-1_LightChain
cagagcgugcugacccagccccccagcgccagcgccacccccggccagagagugaccaucagcugcagcggcagcagcagcaacaucggcagcaagcacguguacugguaccagaagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacagaagccugagcgccggcggcguguucggcaccggcaccaaggugaccgugcug

SEQ ID NO: 32177 - RNA, 432 nt, Artificial Sequence
  derived and/or modified sequence opt4 from anti-HIV-1_HeavyChain
caggcccagcugguggagagcggcggcggcguggugcagcccggcagaagccugagacugagcugcgccgccagcggcuucaccuucagcagcuacggcauccacugggugagacaggcccccggcaagggccuggaguggguggccgugaugagcagcgacggcaccuacaaguacuacggcgacagcaugaagggcagauucaccaucagcagagacaacagcaagaacagccuguaccugcagaugaacagccugagagccguggacaccgccguguacuacugcgccaaggaccugggcgagggcgagaacgaggagugggccaccgacuacuacgacuucagcaucggcuaccccggccaggaccccagaggcguggugggcaccuucgacaucuggggccagggcaccauggugaccgugagcagc

SEQ ID NO: 32178 - RNA, 426 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucagcgacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagagccguggugggcgccuucuggggccagggcaccauggugaccgugagcagc

SEQ ID NO: 32179 - RNA, 432 nt, Artificial Sequence
  derived and/or modified sequence opt4 from anti-HIV-1_HeavyChain
caggugcagcugguggagagcggcggcggcguggugcagagcggcagaagccugagacugagcugcgccgccagcggcuucaccuucagcgccuacgcccugcacugggugagacaggcccccggcaagggccuggaguggguggccgugaucagcuacgacggcagagacaaggacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagagccguggugggcgccuucgacaucuggggccagggcaccauggugaccgugagcagc

SEQ ID NO: 32180 - RNA, 432 nt, Artificial Sequence
  derived and/or modified sequence opt4 from anti-HIV-1_HeavyChain
caggugcagcuggugcagagcggcggcggccuggugcagcccggcagaagccugagacugagcugcguggccagcggcuucagauucagcuuccacggcaugcacugggugagacaggcccccggcaagggccuggaguggguggccguggugagcgacgacggcagcgaccagaaguacguggacagcgugaagggcagacugaccaucagcagagacaacagcaagaacaccguguaccugcagaugaacagccugagagccgaggacaccgccguguacuacugcgccaaggaccugggcgagagcgagaacgaggagugggccagcgacuacuacgacuucggcagcgacuaccccggccaggaccccagagccguggugggcgccuucgacaucuggggccagggcaccauggugaccgugagcagc

SEQ ID NO: 32181 - RNA, 432 nt, Artificial Sequence
  derived and/or modified sequence opt4 from anti-HIV-1_HeavyChain
gaggugcaccugguggagagcggcggcggcguggugcagcccggcagaagccugagacugagcugcgccgccagcggcuucaccuucaacagcuacgccaugaucugggugagacaggcccccggcaagggccuggaguggguggccgugaucagcuacgacggcaacaacaaguacuacgccgacagcgugaagggcagauucaccaucagcagagagaacagcaagaacacccuguaccugcagaugaacagccugagagccgaggacaccgccguguaccacugcgccaaggaccugggcgagagcgagaacgaggagugggccagcgacuacuacgacuucggcagagacuaccccggccaggaccccagaggcguggugggcaccuucgacaucuggggccacggcaccauggugaccgugagcagc

SEQ ID NO: 32182 - RNA, 432 nt, Artificial Sequence
  derived and/or modified sequence opt4 from anti-HIV-1_HeavyChain
caggugcagcugguggagagcggcggcggcguggugagacccggcggcagccugagacugagcugcaccgccagcggcuuccacuucaacaaguacggcaugaacugggugagacaggcccccggcaagggccuggcccugguggccuucauccagagcggcgccagcuacaacuacuacgccgacagcgugaagggcagauucaccaucagcagagacaacagcaagaacacccuguaccugcagaugaacagccugagagccgaggacaccgccguguacuacugcgccaaggaccugggcgacagcgagaacgaggagugggccagcgacuacuacgacuucggcagagacuaccccggccaggaccccagaggcguggugggcgccuucgacaucuggggccacggcaccauggugaccgugagcagc

SEQ ID NO: 32183 - RNA, 432 nt, Artificial Sequence
  derived and/or modified sequence opt4 from anti-HIV-1_HeavyChain
caggugcaccugguggagagcggcggcggcguggugcagcccggcaagagccugaccaucuacugcgccgugagcgaguucacccugagcaacuacgccaugcacugggugagacugacccccggcaagggccugcaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagagacuaccccggccaggaccccagaggcguggugggcguguucgacaucuggggccagggcaccauggugaccgugagcagc

SEQ ID NO: 32184 - RNA, 432 nt, Artificial Sequence
  derived and/or modified sequence opt4 from anti-HIV-1_HeavyChain
gaggugcagcugcuggagagcggcggcggcguggugcagcccggcagaagccugagacugagcugcgccgccagcggcuucaccuucagcaccuacgcccugcacugggugagacaggcccccggcaagggccuggaguggguggccgugaucagcuacgacggcagcaccaaguucuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagagccguggugggcgccuucgacaucuggggccagggcaccauggugaccgugagcagc

SEQ ID NO: 32185 - RNA, 432 nt, Artificial Sequence
  derived and/or modified sequence opt4 from anti-HIV-1_HeavyChain
caggugcagcugguggagagcggcggcggcguggugcagcccggcggcagccugagacugagcugcgccgccagcggcuucaccuucagcagcuacggcaugcacugggugagacaggcccccggcaagggccuggaguggguggccuucaucagauacgacggcagcaacaaguacuacgccgacagcgugaagggcagauucaccaucagcagagagaacagcaagaacacccuguaccugcagaugaacagccugagagccgaggacaccgccguguaccacugcgccaaggaccugggcgagagcgagaucgaggaguggaccagcgacuacuacgacuucggcagagacuaccccggccaggaccccagaggcguguucggcaccuucgacaucuggggccacggcaccauggugaccgugagcagc

SEQ ID NO: 32186 - RNA, 432 nt, Artificial Sequence
  derived and/or modified sequence opt4 from anti-HIV-1_HeavyChain
gaggugcagcugguggagagcggcggcggcguggugaagcccggcggcagccugagacugagcugcguggugagcggcuucaccuucagcaacgccuggaugagcugggugagacaggcccccggcaagggccuggaguggguggccgugaucagcgacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagagccguggugggcgccuucgacaucuggggccagggcaccauggugaccgugagcagc

SEQ ID NO: 32187 - RNA, 432 nt, Artificial Sequence
  derived and/or modified sequence opt4 from anti-HIV-1_HeavyChain
caggugcagcugguggagagcggcggcggcguggugcagcccggcggcagccugagacugagcugcgccgccagcggcuucaccuucagcaccuacggcaugcacugggugagacaggcccccggcaagggccuggaguggguggccuucaucagauacgacggcagaaacaagaacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacgacuucagcaucggcuaccccggccaggaccccagaggcguggugggcaucuucgacaucuggggccagggcaccauggugaccgugagcagc

SEQ ID NO: 32188 - RNA, 432 nt, Artificial Sequence
  derived and/or modified sequence opt4 from anti-HIV-1_HeavyChain
caggugcaccugguggagagcggcggcggcguggugcagcccggcggcagccugagacugagcugcgccgccagcggcuucagcuucagcaucuacggcaugcacugggugagacaggcccccggcaagggccuggagugggugaccuucaccagauacgacggcagcaacaaguacuacaccgacagcgugaagggcagauucaccaucagcagagacaacagcaagaacacccuguaccugcagaugaacagccugagaaccgaggacaccgccguguacuacugcgccaaggaccugggcgagagcgagaacgaggagugggccagcgacuacuacgacuucggcagcgacuaccccggccaggaccccagagccguggugggcgccuucgacaucuggggccagggcaccauggugaccgugagcagc

SEQ ID NO: 32189 - RNA, 432 nt, Artificial Sequence
  derived and/or modified sequence opt4 from anti-HIV-1_HeavyChain
caggugcagcugguggagagcggcggcggcguggugcagcccggcggcagccugagacugagcugcgccgccagcggcuucaccuucagcagcuacggcaugcacugggugagacaggcccccggcaagggccuggaguggguggccuucaucagauacgacggcagcaacaaguacuacgccgaccccgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagagacuaccccggccaggaccccagaggcguggugggcguguucgacaucuggggccagggcaccauggugaccgccagcagc

SEQ ID NO: 32190 - RNA, 432 nt, Artificial Sequence
  derived and/or modified sequence opt4 from anti-HIV-1_HeavyChain
gagaugcagcugguggagagcggcggcggccuggugcagcccggcggcagccugagacugagcugcgccgccagcggcuucaccuucagcagcuacuggaugagcugggugagacaggcccccggcaagggccuggaguggguggccgugaucagcuacgacggcaacaacaaguacuacgccgacagcgugaagggcagauucaccaucagcagagagaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagaggcguggugggcaccuucgacaucuggggccacggcaccauggugaccgugagcagc

SEQ ID NO: 32191 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcugcgccaugcacugggugagacaggcccccggcaagggccuggaguggguggccgugaucagcuacgacggcaacaacaagcacuacgccgacagcgugaagggcagauucaccaucagcagagacaacagcaagaacacccuguaccugcagaugaacagccugagagccgaggacauggccguguacuacugcgccaaggaccugggcgagagcgagaacgaggagugggccagcgacuacuacgacuucuggagagacuaccccggccaggaccccagaggcugggugggcaccuucgacaucuggggccagggcaccauggugaccgugagcagc

SEQ ID NO: 32192 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcaacuacggcaugcacugggugagacaggcccccggcaagggccuggagugggugaccgugaucagcagcgacggcagcaagaaguacuacgccgacagcgugaagggcagauucaccaucagcagagacaacagcaagaacacccuguaccugcagaugaacggccugagagccgacgacaccgccguguacuacugcgccaaggaccugggcgacagcgagaacgaggagugggccagcgacuacuacgacuucggcagagacuaccccggccaggaccccagaggcguggugggcgccuucgacaucuggggccacggcaccauggugaccgugagcagc

SEQ ID NO: 32193 - RNA, 432 nt, Artificial Sequence
  derived and/or modified sequence opt4 from anti-HIV-1_HeavyChain
caggugcagcugguggagagcggcggcggcguggugcagcccggcggcagccugagacugagcugcgccgccagcggcuucaccuucagcagcuacggcaugcacugggugagacaggcccccggcaagggccuggaguggguggccuucaucagauacgacggcagcaacaaguacuacgccgacagcgugaagggcagauucaccaucagcagagacaacagcaagaacacccuguaccugcagaugaacagccugagagccguggacaccgccguguacuacugcgccaaggaccugggcgagggcgagaacgaggagugggccaccgacuacuacgacuucagcaucggcuaccccggccaggaccccagaggcguggugggcgccuucgacaucuggggccagggcaccauggugaccgugagcagc

SEQ ID NO: 32194 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagaaacuacggcaugcacugggugagacagagccccggcaagggccuggaguggguggccgugaucagcuacgacggcaagaucaucaacuacaucgacuucgugaagggcagauucaccaucagcagagagaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagaggcguggugggcaccuucgacaucuggggccacggcaccauggugaccgugagcagc

SEQ ID NO: 32195 - RNA, 432 nt, Artificial Sequence
  derived and/or modified sequence opt4 from anti-HIV-1_HeavyChain
gaggugcagcugcuggagagcggcggcggccuggugcagcccggcagaagccugagacugagcugcgccgccagcggcuucaccuucagcagcuacgugaugcacugggugagacaggcccccggcaagggccuggaguggguggccgugaucagcuacgacggcagcaacaagcacuacgccgacagcgugaagggcagauucaccaucagcagagacaacagcaagaacacccuguaccugcagaugaacagccugagagccgaggacaccgccguguacuacagagccaaggaccugggcgagagcgagaacgaggagugggccagcgacuacuacgacuucggcagagacuaccccggccaggaccccagaggcguggugggcgugcuguacaucuggggccagggcaccauggugaccgugagcagc

SEQ ID NO: 32196 - RNA, 432 nt, Artificial Sequence
  derived and/or modified sequence opt4 from anti-HIV-1_HeavyChain
gaggugcagcugguggagagcggcggcggccuggugaagcccggcggcagccugagacugagcugcgccgccagcggcuucaccuucagcaccuacagcaugcacugggugagacaggcccccggcaagggccuggaguggguggccgugaucagcuacgacggcaacaacaaguacuacgccgacagcgugaagggcagauucaccaucagcagagagaacagcaagaacacccuguaccugcagaugaacagccugagagccgaggacaccgccguguaccacugcgccaaggaccugggcgagagcgagaacgaggagugggccagcgacuacuacgacuucggcagagacuaccccggccaggaccccagaggcguggugggcaccuucgacaucuggggccacggcaccauggugaccgugagcagc

SEQ ID NO: 32197 - RNA, 432 nt, Artificial Sequence
  derived and/or modified sequence opt4 from anti-HIV-1_HeavyChain
caggugcagcugguggacagcggcggcggcguggugcagcccggcagaagccugagacuguucugcgccgugagcggcuucaccuucagcaccuacaccaugcacugggugagacaggcccccggcagaggccuggaguggguggccgugaucagcuacgacggcagcaccaaguacuacgccgacagcgugcagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagagccguggugggcgccuucgacaucuggggccagggcaccauggugaccgugagcagc

SEQ ID NO: 32198 - RNA, 426 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcuucggcaugcacugggugagacaggcccccggcaagggccuggaguggguggccgugaucagcuacgacggcaacaacaaguacuacgccgacagcgugaagggcagauucaccaucagcagagagaacagcaagaacacccuguaccugcagaugaacagccugagacccgaggacaccgccguguacuacugcgccaaggaccugggcgagagcgagaacgaggagugggccagcgacuacuacgacuucggcagagacuaccccggccaggaccccagaggcguggugggcaccuucgacaucuggggccacggcaccauggugaccgug

SEQ ID NO: 32199 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucauguucagcagauacggcaugcacugggugagacaggcccccggcaagggccuggaguggguggccgugaucagccacgacggcagcaacaaguacuacgccgacagcgugaagggcagauucaucaucagcagagacaacagcaagaacacccuguaccugcagaugaacagccugagagccgacgacaccgccguguacuacugcgccaaggaccugggcgagagcgagaacgaggagugggccagcgacuacuacgacuucuggaucggcuaccccggccaggaccccagaggcguggugggcgccuucgacaucuggggccagggcaccauggugaccgugagcagc

SEQ ID NO: 32200 - RNA, 432 nt, Artificial Sequence
  derived and/or modified sequence opt4 from anti-HIV-1_HeavyChain
caggugcagcugguggagagcggcggcggcguggugcagcccggcggcagccugagacugagcugcgccgccagcgccuucaccuucagcagcuacggcaugcacugggugagacaggcccccggcaagggccuggaguggguggccuucaucagauacgacggcagcaacaaguacuacgccgacagcgugaagggcagauucaccaucagcagagacaacagcaagaacacccuguuccugcagaugaacagccugagagccgaggacauggccguguacuacugcgccaaggaccugggcgagagcgagaacgaggagugggccagcgacuacuacgacuucuggagagacuaccccggccaggaccccagaggcugggugggcaccuucgacaucuggggccagggcaccauggugaccgugagcagc

SEQ ID NO: 32201 - RNA, 426 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcuucggcaugcacugggugagacaggcccccggcaagggccuggaguggguggccgugaucagcuacgacggcagcaacaaguacuacguggacagcgugaagggcagauucaccaucagcagagacaacagcaagaacacccuguaccugcagaugaacagccugagagccgaggacaccgccguguacgccaaggaccugggcgagagcgagaacgaggagugggccagcgacuacuacgacuucggcagcgacuaccccggccaggaccccagaggcguggugggcaccuucgacaucuggagccagggcaccauggugaccgugagcagc

SEQ ID NO: 32202 - RNA, 432 nt, Artificial Sequence
  derived and/or modified sequence opt4 from anti-HIV-1_HeavyChain
caggugcagcugguggagagcggcggcggcguggugcagcccggcggcagccugagacugagcugcgccgccagcggcuucaccuucagcaccuacggcaugcacugggugagacaggcccccggcaagggccuggacuggguggccuucaucagauacgacggcagccacaaguacuacgccgacagcgugaagggcagauucaccaucagcagagagaacagcaagaacacccuguaccugcagaugaacagccugagacccgaggacaccgccguguacuacugcgccaaggaccugggcgagagcgagaacgaggagugggccagcgacuacuacgacuucggcagagacuaccccggccaggaccccagaggcguggugggcaccuucgacaucuggggccacggcaccauggugaccgugagcagc

SEQ ID NO: 32203 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgugaucagcuacgacggcagcggcgacuacuacgccgacagcgugaagggcagauucaccaucagcagagacaacagcaagagcacccuguaccugcagaugaacagccugagacccgaggacaccgccguguacuacugcgccaaggaccugggcgagagcgagaacgaggagugggccagcgacuacuacgacuucggcagagacuaccccggccaggaccccagaggcguggugggcaccuucgacaucuggggccacggcaccauggugaccgugagcagc

SEQ ID NO: 32204 - RNA, 432 nt, Artificial Sequence
  derived and/or modified sequence opt4 from anti-HIV-1_HeavyChain
caggugcaccugguggagagcggcggcggcguggugcagcccggcggcagccugagacugagcugcgccgccagcggcuucaccuucagcaccuacggcaugcagugggugagacaggcccccggcaagggccuggaguggguggccuucaucaagaacgacggcaccaacgaguucuacggcgacagcgugaagggcagauucaccaucagcagagacaacagcaagaacaccgugagccugcacauggacagccugagacccgaggacaccgcccuguacuacugcgccaaggaccugggcgagagcgagaacgaggagugggccagcgacuacuacgacuucggcagcgacuaccccggccaggaccccagagccguggugggcgccuucgacaucuggggccagggcaccauggugaccgugagcagc

SEQ ID NO: 32205 - RNA, 432 nt, Artificial Sequence
  derived and/or modified sequence opt4 from anti-HIV-1_HeavyChain
caggugcagcugguggagagcggcggcggcguggugcagcccggcggcagccugagacugagcugcguggccagcggcuucaccuucagcagcuacggcaugcacugggugagacaggcccccggcaagggccuggaguggguggccuucaucagauacgacggcagaaacaaguacuacgccgacagcgugaagggcagauucaccaucagcagagacaagagcaagaacacccugugccugcagaugaacagccugagaguggaggacaccgccguguacuacugcgccaaggaccugggcgacagcgagaacgaggagugggccagcgacuacuacgacuucggcagagacuaccccggccaggaccccagaggcguggugggcgccuucgacaucuggggccacggcaccauggugaccgugagcagc

SEQ ID NO: 32206 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucagcuacgacggcagcaacaaguacuacagagacagcgugaagggcagauucaccaucagcagagacaacagcaagaacaccguguaccugcagaugaacagccugagagccgaggacaccgccguguacuacugcgccaaggaccugggcgagagcgagagcgaggagugggccagcgacuacuacgacuucggcagagacuaccccggccaggaccccagaggcguggugggcgcccuggacaucuggggccagggcaucauggugaccgugagcagc

SEQ ID NO: 32207 - RNA, 432 nt, Artificial Sequence
  derived and/or modified sequence opt4 from anti-HIV-1_HeavyChain
gaggugcagcugguggagagcggcggcggcauggugcagcccggcagaccccugagacugagcugcgccgccagcggcuucaucuucagcggcuucggccugcacugggugagacaggcccccggcaagggccuggaguggguggccagcaucagcuacgacggcggcaacaaguacuacgccgacagcgugagaggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagagccguggugggcgccuucgacaucuggggccagggcaccauggugaccgugagcagc

SEQ ID NO: 32208 - RNA, 432 nt, Artificial Sequence
  derived and/or modified sequence opt4 from anti-HIV-1_HeavyChain
gaggugcagcugguggagagcggcggcggcguggugagacccggcggcagccugagacugagcugcgccgccagcggcuucaccuucaacgacuacggcauggccugggugagacaggcccccggcaagggccuggaguggguggccgacaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagagacuaccccggccaggaccccagaggcguggugggcgccuucgacaucuggggccagggcaccauggugaccgugagcagc

SEQ ID NO: 32209 - RNA, 429 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccguggugagcuacgacgagagcaaguacuacgccgacagcgugaagggcagauucaccaucagcagagacaacagcaagaacacccuguaccugcagaugaacagccugagagccgaggacauggccguguacuacugcgccaaggaccugggcgagagcgagaacgaggagugggccagcgacuacuacgaguucuggagagacuaccccggccaggaccccagaggcugggugggcaccuucgacaucuggggccagggcaccauggugaccgugagcagc

SEQ ID NO: 32210 - RNA, 432 nt, Artificial Sequence
  derived and/or modified sequence opt4 from anti-HIV-1_HeavyChain
caggugcagcugguggagcccggcagaggcguggugcaccccggcggcagccugagacugagcugcgugaccagcggcuucaccuucgagaacuuccccaugcacugggugagacaggcccccggcaagggccuggaguggguggcccugaucagcuacgacggcagcgacaaguacuacagcgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagaggcguggugggcaccuucgacaucuggggccacggcaccauggugaccgugagcagc

SEQ ID NO: 32211 - RNA, 432 nt, Artificial Sequence
  derived and/or modified sequence opt4 from anti-HIV-1_HeavyChain
caggcccagcugguggagagcggcggcggcguggugcagcccggcagaagccugagacugagcugcgccgccagcggcuucagcuucgccacccacgccaugcacugggugagaagaagccccggcaagggccuggaguggguggccaccaucagcuacggcggcaagaacgaguacuacgccgacagcgugaagggcagauucaccaucagcagagagaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagaggcguggugggcaccuucgacaucuggggccacggcaccauggugaccgugagcagc

SEQ ID NO: 32212 - RNA, 432 nt, Artificial Sequence
  derived and/or modified sequence opt4 from anti-HIV-1_HeavyChain
gccgugcagcugguggagagcggcggcggccuggugaagcccggcggcagccugagacugagcugcgccgccagcggcuucaccuucuucaacaccuggaugagcugggugagacagagccccggcaagggccuggaguggguggccgacaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagagacuaccccggccaggaccccagaggcguggugggcguguucgacaucuggggccagggcaccauggugaccgugagcagc

SEQ ID NO: 32213 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagagccguggugggcgccuucgacaucuggggccagggcaccauggugaccgugagcagc

SEQ ID NO: 32214 - RNA, 432 nt, Artificial Sequence
  derived and/or modified sequence opt4 from anti-HIV-1_HeavyChain
caggugagacugguggagagcggcggcagaguggugcagcccggcggcagccugagacugagcugcguggccagcggcuucaccuucagcagcuacggcauccacugggugagacaggcccccggcaagggccuggagugggugaccuucaucuggcacgacggcagagacaccuacuacgccgacgccgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacgacuucuggaccggcuaccccggccaggaccccagagccguggugggcgccuucgacaucuggggccagggcaccauggugaccgugagcagc

SEQ ID NO: 32215 - RNA, 432 nt, Artificial Sequence
  derived and/or modified sequence opt4 from anti-HIV-1_HeavyChain
caggugcaccugguggagagcggcggcggcguggugcagcccggcagaagccugagaaucuacugcgccgugagcgaguucaccuucagaaacuacgccaugcacugggugagacuggcccccggcaagggccugcaguggguggccgugaucagcuacgacggcagcaacaaguacuacggcgacagcgugaagggcagauucaccaucagcagagacaacagcaagaacacccuguaccugcagauggacagccugagagccgaggacaccgccguguacuacugcgccaaggaccugggcgagagcgagaacgaggagugggccagcgacuacuacgacuucggcagagacuaccccggccaggaccccagaggcguggugggcaccuucgacaucuggggccacggcaccauggugaccgugagcagc

SEQ ID NO: 32216 - RNA, 432 nt, Artificial Sequence
  derived and/or modified sequence opt4 from anti-HIV-1_HeavyChain
gaggugcagcugguggagagcggcggcggccuggugaagcccggcggcagccugagacugagcugcgccgccagcggcuucaccuucagcgacgccuggaugagcugggugagacaggcccccggcaagggcauggaguggguggccgugaucagcuacgacggcagcaacaaguacuacgccgacagcgugaagggcagauucaccaucagcagagacaacagcaagaacacccuguaccugcagaugaacagccugagagccguggacaccgccguguacuacugcgccaaggaccugggcgagggcgagaacgaggagugggccaccgacuacuacgacuucagcaucggcuaccccggccaggaccccagaggcguggugggcgccuucgacaucuggggccagggcaccauggugaccgugagcagc

SEQ ID NO: 32217 - RNA, 432 nt, Artificial Sequence
  derived and/or modified sequence opt4 from anti-HIV-1_HeavyChain
gaggugcaggugguggagagcggcggcggccuggugaagcccggcggcagccugagacugagcugcgaggccagcggcuucaccuucagcaacgccuggaugagcugggugagacaggcccccggcaagggccuggaguggguggccgugaucagcuacgacggcaacaacaaguacuacgccgacagcgugaagggcagauucaccaucagcagagagaacagcaagaacacccuguaccugcagaugaacagccugagagccgaggacaccgccguguaccacugcgccaaggaccugggcgagagcgagaacgaggagugggccagcgacuacuacgacuucggcagagacuaccccggccaggaccccagaggcguggugggcaccuucgacaucuggggccacggcaccauggugaccgugagcagc

SEQ ID NO: 32218 - RNA, 432 nt, Artificial Sequence
  derived and/or modified sequence opt4 from anti-HIV-1_HeavyChain
caggugcagcugguggagagcggcggcggcguggugcagcccggcggcagccugagacugagcugcgccgccagcggcuucaccuucagcagcuacggcauccacugggugagacaggcccccggcaagggccuggaguggguggccuucaucagaagcgacgccaccaacaaguacuacgccgacagcgugaagggcagauucaccaucagcagagagaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagaggcguggugggcaccuucgacaucuggggccacggcaccauggugaccgugagcagc

SEQ ID NO: 32219 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcuucggcaugcacugggugagacaggcccccggcaagggccuggaguggguggccgugaucagcuacgacggcaacaacaaguacuacgccgacagcgugaagggcagauucaccaucagcagagagaacagcaagaacacccuguaccugcagaugaacagccugagagccgaggacaccgccguguacuacugcgccaaggaccugggcgagagcgagaacgaggagugggccagcgacuacuacgacuucggcagcgacuaccccggccaggaccccagaggcguggugggcaccuucgacaucuggggccacggcaccauggugaccgugagcagc

SEQ ID NO: 32220 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcaacuacgccauggacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacgacuucuggaccggcuaccccggccaggaccccagagccguggugggcgccuucgacaucuggggccagggcaccauggugaccgugagcagc

SEQ ID NO: 32221 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccguggugagcuacgacgagagcaacaaguacuacgccggcagcgugaagggcagauucaccaucagcagagacaacagcaagaacacccuguaccugcagaugaacagccugagaaccgaggacauggccguguacuacugcgccaaggaccugggcgagagcgagaacgaggagugggccagcgacuacuacgacuucggcagagaguaccccggccaggaccccagaggcugggugggcaccuucgacaucuggggccagggcaccauggugaccgugagcagc

SEQ ID NO: 32222 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucagcuacgacggcagcaacaaguacuacguggacagcgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacgacuucagcaucggcuaccccggccaggaccccagaggcguggugggcaucuucgacaucuggggccagggcaccauggugaccgugagcagc

SEQ ID NO: 32223 - RNA, 432 nt, Artificial Sequence
  derived and/or modified sequence opt4 from anti-HIV-1_HeavyChain
caggugcagcugguggagagcggcggcggcguggugcagcccggcagaagccugagacugagcugcgccgccagcggcuucaccuucagcaccagcggcaugcacugggugagacaggcccccggcaagggcauggaguggguggccgugaucagcuacgacggcagcaacaaguacuacgccgacagcgugaagggcagauucaccaucagcagagacaacagcaagaacacccuguaccugcagaugaacagccugagagccguggacaccgccguguacuacugcgccaaggaccugggcgagggcgagaacgaggagugggccaccgacuacuacgacuucagcaucggcuaccccggccaggaccccagaggcguggugggcgccuucgacaucuggggccagggcaccauggugaccgugagcagc

SEQ ID NO: 32224 - RNA, 363 nt, Artificial Sequence
  derived and/or modified sequence opt4 from anti-HIV_C38-VRC18.02_HeavyChain
caggugagacuggugcagagcggcaaccaggugagaaagcccggcgccagcgugagaaucagcugcgaggccagcggcuacaaguucaucgaccacuucauccacugggugagacaggugcccggccacggccuggaguggcugggcuggaucaaccccagaggcggcggcgugaacuacagcagaagcuuccagggcaagcugagcaugaccaugaccagagacaacuucgaggagaccgccuaccuggaccugagcaagcugaaccccggcgacaccgccguguacuucugcgccagaggcuucgccggcuacgaguggagcuucaucuggggccagggcacccuggugaucgugagcagc

SEQ ID NO: 32225 - RNA, 396 nt, Artificial Sequence
  derived and/or modified sequence opt4 from anti-HIV_44-VRC13.02_HeavyChain
caggugcagcuggugcagagcggcaccgcccugaagagccccggcagcagcgccaagcugagcugcaccgugcugggcgacgaguucggcaccuacuucaucagcuggaucagacaggcccccggccagggccuggagugggugggcggcaucgugccccacagccagcugcagagcagcgcccagaaguuccacggcagaaucaucaucagcgccggcgccggcgugaccccccccguggugagccugcagcugaccaaccugaccuucgaggacaccggcaccuacuucugcgccagagagagaggcagacacagagaccccaagaccggcgacgcccugagaggcagauacuucgacuucuggggcagaggcaccggccugagagugagcacc

SEQ ID NO: 32226 - RNA, 321 nt, Artificial Sequence
  derived and/or modified sequence opt4 from anti-HIV-1_LightChain
gacaucaagcugacccagagccccgccuuccugagcgccagcgugggcgagagagugaccuucaccugcagagccagccaggacaucagccacgaccuggugugguuccagcagaaggccggcagagcccccagccugcugauguucuacggcagcacccuggagagaggcgugccccccagauucagcggcagaagaagcggcaccgaguucaccgugaccaucgacagccugcagcccgaggacgugggcaccuacuacugccagcagcugagcgccuucccccugaccuucggcggcggcaccaccguggacaucaag

SEQ ID NO: 32227 - RNA, 321 nt, Artificial Sequence
  derived and/or modified sequence opt4 from anti-HIV-1_LightChain
gacaucaagaugacccagagccccgccuuccugagcgccagcgugggcgagagagugaccuucaccugcagagccagccaggacaucagccacgacguggugugguuccagcagaagagcggcagcgcccccaagcugcugauguucuacggcagcacccuggagagaggcgugccccccagauucagcggcagaagaagcggcaccgaguucaccgugaccaucgacggccugcagcccgaggacgugggcaccuacuacugccagcagcugagcgccuucccccugaccuucggcggcggcaccaccguggacaucaag

SEQ ID NO: 32228 - RNA, 321 nt, Artificial Sequence
  derived and/or modified sequence opt4 from anti-HIV-1_LightChain
gacaucaagcugacccagagccccgccuuccugagcgccagcgugggcgagagagugaccuucaccugcagagccagccaggacaucagacacgagcuggugugguaccagcagaagcccggcagaggccccaagcugcugaucuacuacggcagcacccuggagggcggcgugcccagcagauucagcggcagaagaagcggcaccgaguucaccgugaccaucagcagccugcagcccgaggacgugggcaccuacuacugccagcagcugaacagcuucccccugaccuucggcggcggcaccaccguggacaucaga

SEQ ID NO: 32229 - RNA, 321 nt, Artificial Sequence
  derived and/or modified sequence opt4 from anti-HIV-1_LightChain
gacauccagcugacccagagccccagcuuccugagcgccagcgugggcgacagagugagcaucaccugcagagccagccagggcaucaagcacgagcuggccugguaccagcagaagcccggcagagcccccagccugcugaucuacuacgccagcacccuggccagaggcgugcccagcagauucagcgccagcuggagcggcacccuguucacccugaccaucaacggccugcagcccgaggacuucgccaccuacuucugccagcagaugaacagccugccccugaccuucggcggcggcaccaagauggacgugaga

SEQ ID NO: 32230 - RNA, 321 nt, Artificial Sequence
  derived and/or modified sequence opt4 from anti-HIV-1_LightChain
gacauccagcugacccagagccccagcuuccugagcgccagcgugggcgacaaggugaccaucaccugcagagccagccacggcgugagaaacgagcuggccugguaccagcagaagcccggcaaggcccccaaccugcugaucuacuacgccagcacccugcagagcggcgugcccagcagauucagcgccaccggcagcggcacccacuucacccugaccgugagcagccugcagcccgaggacuucgccaccuacuucugccagcacaugagcagcuacccccugaccuucggcggcggcaccaagguggagaucaag

SEQ ID NO: 32231 - RNA, 321 nt, Artificial Sequence
  derived and/or modified sequence opt4 from anti-HIV-1_LightChain
gacauccagcugacccagagccccagcuuccugagcgccagcgugggcgacaaggugaccuucaccugcagagccagccagggcgugagaaacgagcuggccugguaccagcagaagcccggcaaggcccccaaccugcugaucuacuacgccagcacccugcagagcggcgugcccagcagauucagcgccaccggcagcggcacccacuucagccugaccgugagcagccugcagcccgaggacuucgccaccuacuucugccagcacaugagcagcuacccccugaccuucggcggcggcaccaagguggagaucaag

SEQ ID NO: 32232 - RNA, 321 nt, Artificial Sequence
  derived and/or modified sequence opt4 from anti-HIV-1_LightChain
gacauccagcugacccagagccccagcuuccugagcgccagcgugggcgacaaggugaccaucaccugcagagccagccagggcgugagaaacgagcuggccugguaccagcagaagcccggcaaggcccccaaccugcugaucuacuacgccagcacccugcagagcggcgugcccagcagauucagcgccaccggcagcggcacccacuucacccugaccgugagcagccugcagcccgaggacuucgccaccuacuucugccagcacaugagcagcuacccccugaccuucggcggcggcaccaagguggagaucaag

SEQ ID NO: 32233 - RNA, 366 nt, Artificial Sequence
  derived and/or modified sequence opt4 from anti-HIV-1_HeavyChain
agccaguaccuggcccagcccggcgccgagguggccaagcccggcgccagcgugaaggugagcugcaaggugcacggcgacaacuucagaggccacuaccugcacugggugagacaggcccccggccagggccugcaguggaucggcggcaucaaccccuucagcggcgaggccgccuacggcaagagauucgagggcagacugagacugaccagagacaccagcgugaacaccgccuacauggagcuggccaagcugacccccgacgacaccgccguguacuucugcgccagagacaagaccuacaacgacgaguucaccgccauggacaucuggggccacggcaccaccgugaucgugagcagc

SEQ ID NO: 32234 - RNA, 366 nt, Artificial Sequence
  derived and/or modified sequence opt4 from anti-HIV-1_HeavyChain
agccaguaccuggcccagcccggcgccgagguggccaagcccugggccagcgugaaggugagcugcagagugcacggcgacaacuucagaggcuucuaccugcacugggugagacaggcccccggccagggccuggaguggaucggcggcaucaaccccuucagcggcgaggccgccuacggcagaagauucgagggcagacugagacugaccagagacaccagcaucaacaccgccuacauggaggugaccaagcugaccagcgacgacaccgccguguacuucugcgccagagacaagaccuacaacgacgaguucaccgccauggacaucuggggccagggcaccaccgugaucgugagcagc

SEQ ID NO: 32235 - RNA, 366 nt, Artificial Sequence
  derived and/or modified sequence opt4 from anti-HIV-1_HeavyChain
agccaguaccuggcccagagcggcagcgaggugaagaagcccggcgccagcgugaaggugagcugcagacugcacggcgacaaguucggcgcccacuacauccacugggugagacaggcccccggccagggccuggaguggcugggcuucuuccaccccggcaccggcgacgccgugagcgcccagaaguuccagggcagaaucagccugaccagagacaccagcaucagcaccggcuaccuggaggugagaagacugagcagcgacgacaccgccguguacuacugcgccagagacaagaccuacagcgacgaggccaccggcauggacaucuggggccagggcaccaccgugaucgugagcagc

SEQ ID NO: 32236 - RNA, 366 nt, Artificial Sequence
  derived and/or modified sequence opt4 from anti-HIV-1_HeavyChain
agccuggagcuggugcagagcggcaccgaggugaagaagcccggcgccagcgugaaggugagcugcaagcuguucggcgacaccaucaccagcggccccauccacugggugagacaggcccccggccagggccuggaguggaugggcuggaccaacccccacagcggcgacaccgccaccgcccccaaguuccagggcagaguguacaugaccaacgacaagaagaucaacaccgccuuccuggacgugaccagacuggccagcgacgacaccgccaucuacuucugcgccagagacauguacuacagcaacgaggccgugggcauggacguguggggccagggcaccaccgugagcgugagcagc

SEQ ID NO: 32237 - RNA, 366 nt, Artificial Sequence
  derived and/or modified sequence opt4 from anti-HIV-1_HeavyChain
caggaggugcuggugcagagcggcgccgaggugaagaagcccggcgccagcgugaaggugagcugcagagccuucggcuacaccuucaccgcccacgcccugcacugggugagacaggcccccggccagggccuggaguggcugggcuggaucaacccccacagcggcgacaccaccaccagccagaaguuccagggcagaguguacaugaccagagacaagagcaucaacaccgccuaccuggaggugaccagacugaccagcgacgacaccgccaucuucuacugcgccagagacaaguacuacggcgacgaggccgugggcauggacguguggggccagggcaccagcgugaccgugagcagc

SEQ ID NO: 32238 - RNA, 366 nt, Artificial Sequence
  derived and/or modified sequence opt4 from anti-HIV-1_HeavyChain
caggaggugcuggugcagagcggcgccgaggugaagaagcccggcgccagcgugaaggugagcugcagagccuucggcuacaccuucaccggcaacgcccugcacugggugagacaggcccccggccagggccuggaguggcugggcuggaucaacccccacagcggcgacaccaccaccagccagaaguuccagggcagaguguacaugaccagagacaaggccaucaacaccgccuaccuggacgugaccagacugaccagcgacgacaccgccaucuacuacugcgccagagacaaguacuacggcaacgaggccgugggcauggacguguggggccagggcaccagcgugaccgugagcagc

SEQ ID NO: 32239 - RNA, 366 nt, Artificial Sequence
  derived and/or modified sequence opt4 from anti-HIV-1_HeavyChain
caggaggugcuggugcagagcggcgccgaggugaagaagcccggcgccagcgugaaggugagcugcagagccuucggcuacaccuucaccggcaacgcccugcacugggugagacaggcccccggccagggccuggaguggcugggcuggaucaacccccacagcggcgacaccaccaccagccagaaguuccagggcagaguguacaugaccagagacaagagcaucaacaccgccuuccuggacgugaccagacugaccagcgacgacaccggcaucuacuacugcgccagagacaaguacuacggcaacgaggccgugggcauggacguguggggccagggcaccagcgugaccgugagcagc

SEQ ID NO: 32240 - RNA, 303 nt, Artificial Sequence
  derived and/or modified sequence opt4 from anti-HIV_45_LightChain
agccugacccagagccccggcacccugagccugagccccggcgagaccgccaucaucagcugcagaaccagccaguacggcagccuggccugguaccagcagagacccggccaggcccccagacuggugaucuacagcggcagcaccagagccgccggcauccccgacagauucagcggcagcagauggggccccgacuacaaccugaccaucagcaaccuggagagcggcgacuucggcguguacuacugccagcaguacgaguucuucggccagggcaccaaggugcagguggacaucaag

SEQ ID NO: 32241 - RNA, 303 nt, Artificial Sequence
  derived and/or modified sequence opt4 from anti-HIV_45_LightChain
gugcugacccagagccccggcacccugagccugagccccggcgagaccgccaccaucagcugcagaaccagccaguacggcagccuggccugguaccagcagagacccggccaggcccccagacuggugaucuacagcggcagcaccagagccgccggcauccccgacagauucagcggcagcagaagcggccccgacuacacccugaccaucagcaaccuggagagcggcgacuucggcguguacuacugccagcaguacgaguucuucggccagggcaccaaggugcagcaggacaacaag

SEQ ID NO: 32242 - RNA, 303 nt, Artificial Sequence
  derived and/or modified sequence opt4 from anti-HIV_45_LightChain
gugcugacccagagccccggcacccugagccugagccccggcgagaccgccaucaucagcugcagaaccagccaguacggcagccuggccugguaccagcagagacccggccaggcccccagacuggugaucuacagcggcagcaccagagccgccggcauccccgacagauucagcggcagcagauggggccccgacuacaaccugaccaucagcaaccuggagagcggcgacuucggcguguacuacugccagcaguacgaguucuucggccagggcaccaaggugcagguggacaucaag

SEQ ID NO: 32243 - RNA, 363 nt, Artificial Sequence
  derived and/or modified sequence opt4 from anti-HIV_45_HeavyChain
caggugagacugagccagagcggcggccagaugaagaagcccggcgagagcaugagaaucagcugcagagccagcggcuacgaguucaucgacugcacccugaacuggaucagacuggcccccggcagaagacccgaguggaugggcuggcugaagcccagaggcggcgccgugaacuacgccagaguguuccagggcagagugaccaugaccagagacguguacagcgacaccgccuuccuggagcugagaagccugaccgccgacgacaccgccguguacuucugcaccagaggcaagaccguggacuacaacugggacuucgagcacgugggccccggcacccccgugaccgugagcagc

SEQ ID NO: 32244 - RNA, 363 nt, Artificial Sequence
  derived and/or modified sequence opt4 from anti-HIV_45_HeavyChain
caggugagacugagccagagcggcggccagaugaagaagcccggcgagagcaugagaaucagcugccaggccagcggcuacgaguucaucgacugcacccugaacugggugagacuggcccccggcagaagacccgaguggaugggcuggcugaagcccagaggcggcgccgugaacuacgccagaaucuuccagggcagagugaccaugaccagagacguguacagcgacaccgccuuccuggagcugagaagccugaccgccgacgacaccgccguguacuucugcaccagaggcaagaacugcgacuacaacugggacuucgagcacgugggccccggcuaccccgugaccgugagcccc

SEQ ID NO: 32245 - RNA, 375 nt, Artificial Sequence
  derived and/or modified sequence opt4 from anti-HIV_45_HeavyChain
caggugagacugagccagagcggcggccagaugaagaagcccggcgacagcaugagaaucagcugcagagccagcggcuacgaguucaucaacugccccaucaacuggaucagacuggcccccggcaagagacccgaguggaugggcuggaugaagcccagaggcggcgccgugagcuacgccagacagcugcagggcagagugaccaugaccagagacauguacagcgagaccgccuuccuggagcugagaagccugaccagcgacgacaccgccguguacuucugcaccagaggcaaguacugcaccgccagagacuacuacaacugggacuucgagcacuggggccagggcacccccgugaccgugagcagc

SEQ ID NO: 32246 - RNA, 435 nt, Artificial Sequence
  derived and/or modified sequence opt4 from anti-HIV_cap256-206-252885_VR-Chain
caggagcagcugguggagagcggcggcggcguggugccccccggcagcagccugacccugagcugcguggccagcagauucaccuucagcgccuucggcaugcacugggugagacaggcccccggcaagggccuggaguggguggccggcgugagcuucgugggcaucaagaaguacuacgccgacagcgugaagggcagauucaccaucagcagagacaacagcaagaacacccuguuccugcagaugaacggccugagaggcgaggacaccggccuguacuacugcgugaaggacaugagauaccuggagugcgaggagugggccagcgacuacuacgacuucggcaagcccaaccagcccugccuggacagaagaggcgugagcggcaucagcgccuucuggggccagggcaccaccgugaccgugagcagc

SEQ ID NO: 32247 - RNA, 438 nt, Artificial Sequence
  derived and/or modified sequence opt4 from anti-HIV_cap256-206-249183_VR-Chain
caggugcugcugguggagagcggcggcggcgugguggagcccggcaccagccugacccugagcugcgccgccagcagauucaccuucagcaacuucggcaugcacugggugagacagacccccggcggcggccuggaguggguggccagcaucagcaacgagggcaacaagaaguaccacgccgagagcguguggggcagauucaucaucagcagagacaacagcaagaacaccguguuccugcacaugagcagccugagacccgacgacagcgcccuguacuucugcgugagagacagacaggaggacgacugcgaggugugguggagcgacuacgaggccuucggcagagagauccccugcagacaguacagaggccagggccuggccggcaucuucgacaucuggggcagaggcaccauggugaccgugagcagc

SEQ ID NO: 32248 - RNA, 438 nt, Artificial Sequence
  derived and/or modified sequence opt4 from anti-HIV_cap256-206-220956_VR-Chain
cagaugaugcugguggagagcggcggcgacgugguggagcccggcagaagccugacccugagcugcgccaccagccaguucaccuucagcaacuacggcaugcacugggugagacaggcccccggcagaggccuggaguggguggccagcaucagcaacgagggcaacaagaaguaccacgccgagagcguguggggcagacugaucaucagcagagacaacagcaagaacacccuguuccugcacaugagcagccugagagccgacgacagcgcccuguacuucugcgugagagacagacaggaggacgagugcgaggagugguggagcaacuacuacgccuucggcagaggcggccccugcagaaaguacagaggccagggccuggccggcaucuucgacguguggggcagaggcaccauggugaccgugagcagc

SEQ ID NO: 32249 - RNA, 432 nt, Artificial Sequence
  derived and/or modified sequence opt4 from anti-HIV_cap256-206-220629_VR-Chain
caggagcagcugguggagagcggcggcggcguggugccccccggcaagagccugaagcugagcugcguggccagcagauucagcuucggcgccuucggcaugcacugggugagacaggcccccggcaagggccuggaguggguggccggcaucagcuucgccggcaucaagaaguacuacggcgacagcgugaagggcagauucuacaucagcagagacaacagccagaacacccuguuccuggagaugaacggccugagaggcgacgacaccgccagauacuacugcgugaaggaccugagagagcuggagugcgaggagugggccagcgacuacuacgacuucggcaagccccagcccugccuggacagcagaggcgugagcggcaucagcgccauguggggccccggcaccauggugaccgugagcagc

SEQ ID NO: 32250 - RNA, 381 nt, Artificial Sequence
  derived and/or modified sequence opt4 from anti-HIV_cap256-206-200599_VR-Chain
caggagaagcugguggagagcggcggcggcgccgugcagcccggcggcagccugagacugagcugcguggccagcggcuucaccuucaacggcuucggcaugcacugggugagacaggcccccggcaagggccuggaguggguggccaccaucagcuucagcggcguguacaucagcagagagaacagcaagaacacccuguaccugcagaugaacggccugagaggcgaggacaccgcccuguacuacugcgccaaggaccugagauaccuggagugcggcgaguggagcaccuacuacccccagcccugccuggacaccagaggcgugagcggcaucagcaacguguggggccccggcaccagagugaccgugagcagc

SEQ ID NO: 32251 - RNA, 432 nt, Artificial Sequence
  derived and/or modified sequence opt4 from anti-HIV_cap256-206-186347_VR-Chain
caggagcugcugguggagagcggcggcggcguggugccccccggcaagagccugaccaucagcugcguggccagcagauucaccuucagcgccuucggcaugcacugggugagacaggcccccggcaagggccugcaguggguggccagcaucagcuucgccggcaccaagaaguacuacgccgacuucgugaagggcagauucaccaucagcagagacaacagcaagaacaccaucuuccugcagaugaacggccugagaggcgaggacaccgcccuguaccacugcgugaaggacaugagacagcuggagugcgaggaguggaccagcgacuacuacgacuucggcagaccccagcccugcaucgacagaagaggcgugagcggcaucagcgccauguggggccccggcaccauggugaccgugagcagc

SEQ ID NO: 32252 - RNA, 438 nt, Artificial Sequence
  derived and/or modified sequence opt4 from anti-HIV_cap256-206-186226_VR-Chain
cagaugcugcugguggagagcggcggcggcgugguggagcccggcagaagccugacccugagcugcgccaccagccaguucaccuucagcaacuacggcaugcacugggugagacagacccccggcaccggccuggaguggguggccagcaucagcaacgagggcaacaagaaguaccacggcgaggccguguggggcagauucaucaucagcagagacaacagcaagaagacccuguuccugcacaugagcaaccugagagccgacgacagcggccuguacuucugcgugagagacagacaggaggacgagugcgaggagugguggagcgacuacuacagcuucggcagaggcggccccugcagaaaguaccacggccagggccuggccggcaucuucgacaucuggggcagaggcacccuggugaccgugagcagc

SEQ ID NO: 32253 - RNA, 435 nt, Artificial Sequence
  derived and/or modified sequence opt4 from anti-HIV_cap256-206-179686_VR-Chain
caggagcagcugguggagagcggcggcggcguggugccccccuggaagagccugacccugagcugcgaggccagcagauucaccuucagcgccuucggcaugcacugggugagacaggcccccggcaagggccuggaguggguggccggcaucagcuucgccggcaucaagaaguacuacgccgacagcgugaagggcagauucuucaucagcagagacaacagcaagaacagagugcugcuggagaugaacggccugagaagagaggacaccgccagauacuucugcgugaaggaccugagagagcuggagugcgaggagugggccagcgacuacuacgacuucggcaagcccaaccagcccugccuggacagaagaggcgugagcggcaucagcgccauguggggccagggcaccauggugaccgugagcagc

SEQ ID NO: 32254 - RNA, 417 nt, Artificial Sequence
  derived and/or modified sequence opt4 from anti-HIV_cap256-206-173707_VR-Chain
caggagaagcugguggagagcggcggcggcgccgugcagcccggcggcagccugagacugagcugcguggccagcggcuucaccuucaagggcuucggcaugcacugggugagacaggcccccggcaagggccuggaguggguggccaccaucagcuucagcggcgugaagaaguacuacggcaacagcgccaagggcagauucuucaucagcagagacaaccugaagaacaccguguaccuggagaugaacggccugagaggcgaggacaccgcccuguacuacugcgccaaggaccugagauaccuggagugcggcgaguggagcaccuacuacccccagcccugccuggacaccagaggcgugagcggcaucagcaacguguggggccccggcaccaaggugaccgugagcagc

SEQ ID NO: 32255 - RNA, 432 nt, Artificial Sequence
  derived and/or modified sequence opt4 from anti-HIV_cap256-206-173339_VR-Chain
caggagcugcugguggagagcggcggcggcguggugccccccggcaagagccugaagcugagcugcguggccagcagauucaccuucggcgccuucggcaugcacugggugagacaggcccccggcaagggccuggaguggguggccggcaucagcuucgccggcaccaagaacuacuacgccgacagcgugaagggcagauucaccaucagcagagacaaccccaagaacacccuguuccugcagaugaacggccugagaggcgacgacaccggccuguacuacugcgugaaggacaugagagagcuggagugcgagcuguggaccagcgacuacuacgacuucggcagaccccagcccugcaucgaccagagaggcgugagcggcaucagcgccauguggggccagggcaccauggugaccaucagcagc

SEQ ID NO: 32256 - RNA, 438 nt, Artificial Sequence
  derived and/or modified sequence opt4 from anti-HIV_cap256-206-172689_VR-Chain
cagaugaugcugguggagagcggcggcggcgugguggagcccggcagaagccugacccugagcugcgccaccagccacuucaccuucagcaacuacggcaugcacugggugagacaggcccccggcggcagacuggaguggguggccagcaucagcaacgccggcaacaagaaguaccacggcgacagcguguggggcagacugaucaucagcagagacaacagcaagaacacccuguuccugcacaugagcagccugagaguggacgacagcgcccuguacuucugcgugagagacagacaggaggacgagugcgaggagugguggagcgacuacuacgccuucggcagaggcggccccugcagaaaguacagaggccagggccuggccggcaucuucgacaucuggggcagaggcaccauggugaccgugagcagc

SEQ ID NO: 32257 - RNA, 432 nt, Artificial Sequence
  derived and/or modified sequence opt4 from anti-HIV_cap256-206-162744_VR-Chain
caggagaagcugguggagagcggcggcggcguggugccccccggcaagagccugagacugagcugcguggccagcggcuucaccuucagcgccuucggcaugcacugggugagacaggcccccggcaagggccuggaguggguggccggcaucagcuucgccggcaucaagaacuacuacgccgacagcgugaagggcagauucaccaucagcagagacaacagcaagaacagccuguuccugcagaugaacggccugagaggcgacgacaccgccagauacuacugcgugaaggacaugagagagcuggagugcgaggaguggaccagcgacuacuacgacuucggcaagccccagcccugcaucgacagaagaggcgugagcggcaucagcgccauguggggccagggcaccauggugaccaucagcagc

SEQ ID NO: 32258 - RNA, 438 nt, Artificial Sequence
  derived and/or modified sequence opt4 from anti-HIV_cap256-206-146057_VR-Chain
cagaugcagcugguggagagcggcggcggcguggugcagcccggcaccagccugacccugagcugcguggccagccaguucaccuucagcaacuacggcaugcacuggaucagacaggcccccggccagggccuggaguggguggccagcaucagcaacgacggcggcaagagauaccacggcgacgccgugugggccagauucaucaucagcagagacaacagcaagaacaccguguuccugcagaugaccagccugagagccgaggacaccgccagauacuucugcgugagagacagacaggaggacgagugccuggagugguggagcgacuacuacaacuucggcagacagcugcccugcgccaaguucagaggccugggccuggccggcguguucgacaucuggggccacggcaccauggugaccgugagcagc

SEQ ID NO: 32259 - RNA, 435 nt, Artificial Sequence
  derived and/or modified sequence opt4 from anti-HIV_cap256-206-139519_VR-Chain
caggagcagcugguggagagcggcggcggcguggugccccccggcaccagccugagacugagcugcguggccagcagauucagcuucggcagcuucggcaugcacugggugagacaggcccccggcaagggccuggaguggguggccggcaucagcuucgugggcaucaagaaguacuacggcgacagcgugaagggcagauucuucaucagcagagacaacagcaagaacacccuguuccuggagaugaacggccugagaggcgaggacaccgccagauacuacugcgugaaggacaugagagagcuggagugcgaggagugggccagcgacuacuacgacuucggcaagcccaaccagcccugccuggacagaagaggcgugagcggcaucagcgccauguggggccccggcaccaugcugaccgugagcagc

SEQ ID NO: 32260 - RNA, 432 nt, Artificial Sequence
  derived and/or modified sequence opt4 from anti-HIV_cap256-206-136316_VR-Chain
caggagcagcugguggagagcggcggcggcguggugccccccggcaagagccugacccugagcugcguggccagcggcuucaccuucagcgccuucggcaugcacugggugagacaggcccccggcaagggccuggaguggguggccggcaucagcuucgugggcaucaagaaguacuacggcgacagcgugaagggcagauucaccaucagcagagacaacagcaagaacacccuguuccugcagaugaacggccugagaggcgacgacaccgcccuguaccacugcgugaaggacaugagacagcuggagugcgaggaguggaccagcgacuacuacgacuucggcaagccccagcccugcaucgaccccagaggcgugagcggcaucagcgccauguggggccagggcaccauggugaccgugagcagc

SEQ ID NO: 32261 - RNA, 438 nt, Artificial Sequence
  derived and/or modified sequence opt4 from anti-HIV_cap256-206-116098_VR-Chain
cagaugaugcugguggagagcggcggcggcgugguggagcccggcagaagccugacccugagcugcgccgccagccaguucaccuucagcaacuacggcaugcacugggugagacaggcccccggcagagagcuggaguggguggccagcaucagcaacgccggcaacaagaaguaccacggcgaggccguguggggcagacugaucaucagcagagacaacagcaagaacacccuguuccugcacaugagcaaccugagacccgacgacagcgcccuguacuucugcgugagagacagacaggaggacgagugcgaggagugguggagcgacuacuacgccuucggcagaggcggccccugcagaaaguaccacggccagggccuggccggcaucuucgacaucuggggcagaggcaccauggugaccgugagcagc

SEQ ID NO: 32262 - RNA, 432 nt, Artificial Sequence
  derived and/or modified sequence opt4 from anti-HIV_cap256-206-115862_VR-Chain
caggagcagcugguggagagcggcggcggcguggugccccccggcaagagccugagacugagcugcgugggcagcagauucaccuucagcgccuucggcaugcacugggugagacaggcccccggcaagggccuggaguggguggccagcaucagcuucgccggcaccaagaaguacuacguggacagcgugaagggcagauucuucaucagcagagacaacagcaagaacaccguguuccuggagaugaacggccugagaggcgaggacaccggccuguacuacugcgugaaggacaugagagagcuggagugcgaggagugggccagcgacuacuacgacuucggcaagccccagcccugccuggacagaagaggcgugagcggcaucagcgccauguggggccagggcacccuggugaucaucagcagc

SEQ ID NO: 32263 - RNA, 435 nt, Artificial Sequence
  derived and/or modified sequence opt4 from anti-HIV_cap256-206-107018_VR-Chain
caggagcagcugguggagagcggcggcggcguggugccccccggcaagagccugacccugagcugcguggccagcagauucagcuucagcgccuucggcaugcacugggugagacaggcccccggcaagggccuggaguggguggccagcaucagcuucgugggcaucaagaaguacuacggcgacagcgugaagggcagauucuucaucagcagagacaacagcaagaacaccguguuccuggagaugaacggccugagaggcgaggacaccggccuguacuacugcgugaaggacaugagagagcuggagugcgaggagugggccagcgacuacuacgacuucggcaagcccaaccagcccugccuggacagaagaggcgugagcggcaucagcgccauguggggccagggcacccuggugaucgugagcagc

SEQ ID NO: 32264 - RNA, 438 nt, Artificial Sequence
  derived and/or modified sequence opt4 from anti-HIV_cap256-206-098644_VR-Chain
cagaugcugcugguggagagcggcggcggcgugguggagcccggcagaagccugacccugagcugcgccgccagccaguucaccuucagcaacuacggcaugcacugggugagacaggcccccggcggcggccuggaguggguggccagcaucagcaacgagggcaacaagagauaccacggcgagagcguguggggcagauucgugaucagcagagacaacagcaagaacacccuguuccugcacaugagcacccugagacccgacgacagcgcccuguacuucugcgugagagacagacaggaggacgagugcgaggagugguggagcgacuacuacgccuucggcagaggcggccccugcagaaaguaccacggccagggccuggccggcaucuucgacguguggggcagaggcaccauggugaccggccuguuc

SEQ ID NO: 32265 - RNA, 417 nt, Artificial Sequence
  derived and/or modified sequence opt4 from anti-HIV_cap256-206-098135_VR-Chain
caggagaagcugguggagagcggcggcggcgccgugcagcccggcggcagccugagacugagcugcguggccagcggcuucaccuucagcggcuucggcaugcacugggugagacaggcccccggcaagggccuggaguggguggccaccaucagcuucagcggcaugaagaaguacuacggcaccagcgccaagggcagauucagcaucuacagagacaacagcaagaacacccuguaccugcagauggacggccugagagagaaggacaccgcccuguacuacugcgccaaggaccugagauaccuggagugcggcgaguggagcaccuacuacccccagcccugccuggacagaagaggcgugagcggcaucagcaacguguggggccccggcaccauggugaccgugagcagc

SEQ ID NO: 32266 - RNA, 435 nt, Artificial Sequence
  derived and/or modified sequence opt4 from anti-HIV_cap256-206-096276_VR-Chain
caggagcagcugguggagagcggcggcggcguggugccccccggcagcagccugagacugagcugcguggccagcagauucaccuucagcgccuucggcaugcacugggugagacaggcccccggcaagggccuggaguggguggccggcaucagcuucgugggcaucaagaaguacuacgccgacagcgugaagggcagauucaccaucagcagagacaacagcaagaacacccuguuccugcagaugaacggccugagaggcgaggacaccggccuguacuacugcgugaaggacaugagagagcuggagugcgaggaguggagaagcgacuacuacgacuucggcaagcccaaccagcccuaccuggacagaagaggcgugagcggcaucagcgccuucuggggccagggcaccauggugaccgugagcagc

SEQ ID NO: 32267 - RNA, 438 nt, Artificial Sequence
  derived and/or modified sequence opt4 from anti-HIV_cap256-206-092794_VR-Chain
cagaugaugcugguggagagcggcggcggcgugguggagcccggcagaagccugacccugagcugcgccaccagccaguucaccuucagcaacuacggcaugcacugggugagacaggcccccggcagaggccuggaguggguggccagcaucagcaacgagggcaacaagagauaccacggcgagagcguguggggcagauucaucaucagcagagacaacagcaagaacacccuguuccugcacaugagcacccugagagccgacgacagcgcccuguacuucugcgugagagacagacaggaggacgagugcgaggagugguggagcgacuacuacgccuucggcagaggcggccccugcagaaaguaccacggccagggccuggccggcaucuucgacaucgugggcagaggcacccuggugaccgugagcagc

SEQ ID NO: 32268 - RNA, 432 nt, Artificial Sequence
  derived and/or modified sequence opt4 from anti-HIV_cap256-206-086817_VR-Chain
caggagcagcugguggagagcggcggcggcguggugccccccggcaagagccugagacugagcugcgccgccagcggcuucagcuucggcgccuucggcaugcacugggugagacaggcccccggcaagggccuggaguggguggccggcaucagcuucgugggcaucaaguacuacuacgccgacagcgugaagggcagauucaccaucagcagagacaacagcaagaacaccguguuccugcagaugaacggccugagaggcgacgacaccggcagauacuacugcgugaaggacaugagagagcuggagugcgaggaguggaccagcgacuacuacgacuucggcaagccccagcccugcaucgacagaagaggcgugagcggcaucagcgccauguggggccagggcaccauggugaccaucagcagc

SEQ ID NO: 32269 - RNA, 432 nt, Artificial Sequence
  derived and/or modified sequence opt4 from anti-HIV_cap256-206-086446_VR-Chain
caggagcagcugguggagagcggcggcggcguggugccccccggcaagagccugagacugagcugcguggccagcagauucaccuucagcgccuucggcaugcacugggugagacaggcccccggcaagggccuggaguggguggccggcaucagcuucgugggcaucaagaaguacuacagcgacgccgugaagggcagauucuacaucagcagagacaacagcaagaacacccuguuccuggagaugaacggccugagaggcgacgacaccgccagauacuacugcgugaaggaccugagagagcuggagugcgaggagugggccagcgacuacuacgacuucggcaagccccagcccugccuggacagcagaggcgugagcggcaucagcgccauguggggccagggcaccauggugaccgugagcagc

SEQ ID NO: 32270 - RNA, 432 nt, Artificial Sequence
  derived and/or modified sequence opt4 from anti-HIV_cap256-206-086180_VR-Chain
caggagcagcuggaggagagcggcggcggcguggugccccccggcaagagccugagacugagcugcguggccagcagauucaccuucagcgccuucggcaugcacugggugagacaggcccccggcaagggccuggaguggguggccggcaucagcuucgugggcaucaagaaguacuacgccgacagcgugaagggcagauucaccaucagcagagacaacagcaagaacacccuguuccugcagaugaacggccugagaggcgacgacaccggccuguacuucugcgugaaggacaugagagagcuggagugcgagcaguggaccagcgacuacuacgacuucggcaagccccagcccugcaucgaccccagaggcgugagcggcaucagcgccauguggggccagggcaccauggugaccgugagcagc

SEQ ID NO: 32271 - RNA, 435 nt, Artificial Sequence
  derived and/or modified sequence opt4 from anti-HIV_cap256-206-083708_VR-Chain
caggagcagcugguggagagcggcggcggcgugaucccccccggccagagccugagacugagcugcguggccagcagauucaccuucagcgccuucggcaugcacugggugagacaggcccccggcaagggccuggagugggugagcagcgugagcuucgccggcaucaagaaguacuacgccgacagcgugaagggcagauucuucaucagcagagacaacagcaagaacaccguguuccuggagaugaacggccugagaggcgaggacaccggccuguacuacugcgugaaggacaugagagagcuggagugcgaggagugggccagcgacuacuacgacuucggcaagcccgaccagcccugccuggacagaagaggcgugagcggcaucagcgccauguggggccagggcacccuggugaucgugagcagc

SEQ ID NO: 32272 - RNA, 432 nt, Artificial Sequence
  derived and/or modified sequence opt4 from anti-HIV_cap256-206-079556_VR-Chain
caggagcagcugguggagagcggcggcggcguggugccccccggcaagagccugagacugagcugcguggccagcggcuucaccuucagcggcuucggcaugcacugggugagacaggcccccggcaagggccuggaguggguggccggcaucagcuucgugggcaucaaguacuacuacgccgacagcgugaagggcagauucagcaucagcagagacaacagcaagaacacccuguuccugcagaugaacggccugagaggcgacgacaccgcccuguacuacugcgugaaggacaugagagagcuggagugcgaggaguggaccagcgacuacuacgacuucggcaagccccagcccugcaucgacagaagaggcgugagcggcaucagcgccauguggggccagggcaccauggugaccgugagcagc

SEQ ID NO: 32273 - RNA, 438 nt, Artificial Sequence
  derived and/or modified sequence opt4 from anti-HIV_cap256-206-078657_VR-Chain
cagaugcugcugguggagagcggcggcggcgugguggagcccggcagaagccugacccugagcugcgccaccagccaguucaccuucagcaacuacggcaugcacugggugagacaggcccccggcagaggccuggaguggguggccagcaucagcaacgagggcagcaagaaguaccacggcgagcccguguggggcagauucaucaucagcagagacaacagcaagaagacccuguuccugcacaugagcaaccugagaguggacgacagcgcccuguacuucugcgugagagacagacaggaggacgagugcgaggagugguggagcgacuacuacgccuucggcagaggcggccccugcagaaaguaccacggccagggccuggccggcaucuucgacaucuggggcagaggcaccauggugaccgugagcagc

SEQ ID NO: 32274 - RNA, 438 nt, Artificial Sequence
  derived and/or modified sequence opt4 from anti-HIV_cap256-206-075802_VR-Chain
cagaugcugcugguggagagcggcggcgacgugguggagcccggcaagagccugacccugagcugcgccaccagcagauucaccuucagcaacuacggcaugcacugggugagacaggcccccggcggcggccuggaguggguggccagcaucagcaacgagggcaacaagaaguaccacggcgagagcguguggggcagauucaucaucagcagagacaacagcaagaacacccuguuccugcacaugagcgcccugagaaccgacgacagcgcccuguacuucugcgugagagacagacaggaggacgagugcgaggagugguggagcgacuacuacgccuucggcagaggcggccccugcagaaaguaccacggccagggccuggccggcaucuucgacaucuggggcagaggcaccauggugaccgugagcagc

SEQ ID NO: 32275 - RNA, 438 nt, Artificial Sequence
  derived and/or modified sequence opt4 from anti-HIV_cap256-206-069097_VR-Chain
cagaugcugcugguggagagcggcggcggcgugguggagcccggcagaagccugacccugagcugcgccaccagcagauucaccuucagcaacuacggcaugcacugggugagacaggcccccggcagagagcuggaguggguggccagcaucagcaacgagggcaacaagaaguaccacgccgagagcguguggggcagauucaucaucagcagagacaacagcaagaacacccuguuccugcacaugagcaacgugagaggcgacgacagcgcccuguacuucugcgugagagacagacaggaggacgagugcgaggagugguggagcgacuacuacgccuucggcagaggcggccccugcagaaaguaccacggccagggccuggccggcaucuucgacguguggggcagaggcaccguggugaccgugagcagc

SEQ ID NO: 32276 - RNA, 438 nt, Artificial Sequence
  derived and/or modified sequence opt4 from anti-HIV_cap256-206-067758_VR-Chain
cagaugcugcugguggagagcggcggcggcgugguggagcccggcagaagccugacccugagcugcgccgccagccaguucaccuucagccacuacggcaugcacugggugagacaggcccccggcagaggccuggaguggguggccagcaucagcaacgagggcaacaagagauaccacggcgagagcguguggggcagauucaucaucagcagagacaacagcaagaacacccuguuccugcacaugagcgcccugagaaccgacgacagcgcccuguacuucugcgugagagacagacaggaggacgagugcgaggagugguggagcgacuacuacgccuucggcagaggcggccccugcagaaaguggcacggccagggccuggccggcaucuucgacaucuggggcagaggcaccguggugaccgugagcagc

SEQ ID NO: 32277 - RNA, 417 nt, Artificial Sequence
  derived and/or modified sequence opt4 from anti-HIV_cap256-206-057019_VR-Chain
caggagaagcugguggagagcggcggcggcgccgugcagcccggcggcagccugagacugagcugcguggccagcggcuucagcuucagcggcuacggcaugcacugggugagacaggcccccggcaagggccuggaguggcuggccaccaucagcuucagcggcgugaagaaguacuacggcaccagcgccaagggcagauucuacaucuacagagacaacaccaagaacaccauguaccuggagaugaacggccugagaggcgaggacaccgcccuguacuacugcgccaaggaccugagauaccuggagugcggcgaguggagcaccuacuacccccagcccugccuggacaccagaggcgugagcggcaucagcaacguguggggccccggcaccauggugaccgugagcagc

SEQ ID NO: 32278 - RNA, 438 nt, Artificial Sequence
  derived and/or modified sequence opt4 from anti-HIV_cap256-206-055385_VR-Chain
cagaugaugcugguggagagcggcggcggcgugguggagcccggcagaagccugacccugagcugcgccgccagcaaguucaccuucagcaacuacggcaugcacugggugagacaggcccccggcagaggccuggaguggguggccagcaucagcaacgagggcaacaagaaguaccacggcgagcccguguggggcagacugaucaucagcagagacaacagcaagaacacccuguuccugcacaugagcgaccugagagccgacgacagcgcccuguacuucugcgugagagacagacaggaggacgagugcgaggagugguggagcaacuacuacgccuucggcagaggcggccccugcagaaaguggagaggccagggccuggccggcaucuucgacguguggggcagaggcaccauggugaccgugagcagc

SEQ ID NO: 32279 - RNA, 435 nt, Artificial Sequence
  derived and/or modified sequence opt4 from anti-HIV_cap256-206-053187_VR-Chain
caggagcagcugguggagagcggcggcggcguggugccccccggcagcagccugagacugagcugcguggccagcagauucaccuucagcgccuucggcaugcacugggugagacaggcccccggcaagggccuggaguggguggccggcaucagcuucgugggcaucaaguacuacuacgccgacagcgugaagggcagauucaccaucagcagagacaacagcaagaacacccuguuccugcagaugaacggccugagaggcgaggacaccggccuguacuacugcgugaaggacaugagagagcuggagugcgaggagugggccagcgacuacuacgacuucggcaagcccaaccagcccugccuggacagaagaggcgugagcggcaucagcgccuucuggggccagggcaccauggugaccgugagcagc

SEQ ID NO: 32280 - RNA, 438 nt, Artificial Sequence
  derived and/or modified sequence opt4 from anti-HIV_cap256-206-053139_VR-Chain
cagaugcugcugguggagagcggcggcgacgugguggagcccggcagaagccugacccugagcugcgccaccagccaguucaccuucagcaacuacggcaugcacugggugagacaggcccccggcagaggccuggaguggguggccagcaucagcaacgagggcagcaagaaguaccacggcgagagcguguggggcagauucaucaucagcagagacaacagcaagaacacccuguuccugcacaugaccacccugagacccgacgacagcgcccuguacuucugcgugagagacagacaggaggacgagugcgaggagugguggagcgacuacuacgccuucggcagaggcggccccugcagaaaguaccacggccagggccuggccggcaucuucgacaucuggggcagaggcaccauggugaccgugagcagc

SEQ ID NO: 32281 - RNA, 432 nt, Artificial Sequence
  derived and/or modified sequence opt4 from anti-HIV_cap256-206-050350_VR-Chain
caggagcagcugguggagagcggcggcggcguggugccccccggcaagagccugaagcugagcugcguggccagcagauucagcuucggcgccuucggcaugcacugggugagacaggcccccggcaagggccuggaguggguggccggcaucagcuucgugggcaucaagaaguacuacgccgacagcgugaagggcagauucuacaucagcagagacaacagcaagaacaccguguuccuggagaugaacgcccugagaggcgaggacaccgcccuguaccacugcgugaaggacaugagagagcuggagugcgaggagugggccagcgacuacuacgacuucggcaagccccagcccugccuggacagaagaggcgugagcggcaucagcgccauguggggccccggcaccauggugaucgugagcagc

SEQ ID NO: 32282 - RNA, 432 nt, Artificial Sequence
  derived and/or modified sequence opt4 from anti-HIV_cap256-206-046207_VR-Chain
caggagcagcugguggagagcggcggcggcguggugccccccggcaccagccugagacugagcugcguggccagcagauucaccuucagcgccuucggcaugcacugggugagacaggcccccggcaagggccuggaguggguggccggcaucagcuucgccggcaucaagaaguacuacgccgacagcgugaagggcagauucaccaucagcagagacaacagcaagaacagccuguuccuggagaugaacggccugagaggcgacgacaccgcccuguacuacugcgugaaggaccugagauaccuggagugcgagcuguggaccagcgacuacuacgacuucggcagaccccagcccugcaucgacagcagaggcgugagcggcaucagcgccauguggggccccggcaccauggugaccgugagcgcc

SEQ ID NO: 32283 - RNA, 417 nt, Artificial Sequence
  derived and/or modified sequence opt4 from anti-HIV_cap256-206-043389_VR-Chain
caggagaagcugguggagagcggcggcggcgccgugcagcccggcggcagccugagacugagcugcguggccagcggcuucaccuucagcggcuucggcaugcacugguucagacaggcccccggcaagggccuggaguggguggccaccaucagcuucagcggcaucaagaaguacuacaacaccagcgccaagggcagauucuucaucagcagagacaacaccaaggacacccuguaccugcagauggacggccugcaggagaaggacaccgcccuguaccugugcgccaaggaccugagauaccuggagugcggcuacuggagcaccuacuacccccagcccugccuggacaccagaggcgugagcggcaucagcaacguguggggccccggcaccauggugaccgugagcagc

SEQ ID NO: 32284 - RNA, 432 nt, Artificial Sequence
  derived and/or modified sequence opt4 from anti-HIV_cap256-206-042555_VR-Chain
caggagcagcugguggagagcggcggcggcguggugccccccggcaagagccugagacugagcugcguggugagcggcuucaccuucagcgccuucggcaugcacugggugagacaggcccccggcaagggccuggaguggguggccggcaucagcuucgccggcaccaagagcuacuacgccgagagcgugaagggcagauucaccaucagcagagacaacagcaagaacagccuguuccugcagaugaacggccugagaggcgacgacaccgcccuguacuacugcgugaaggacaugagagagcuggagugcgagcuguggaccagcgacuacuacgacuucggcagaccccagcccugcaucgacagaagaggcgugagcggcaucagcgccauguggggccagggcaccauggugaccaucagcagc

SEQ ID NO: 32285 - RNA, 432 nt, Artificial Sequence
  derived and/or modified sequence opt4 from anti-HIV_cap256-206-029720_VR-Chain
caggagaagcugguggagagcggcggcggcguggugcagcccggcagaagccugacccugagcugcguggccagccacuucaccuucagcggcgugggcaugcacugggugagacaggcccccggcaagggccuggaguggguggccggcaucagcuucgccggcaccagaaaguacuacgccgacagcgugaagggcagauucaccaucagcagagacaacagcaagaacaccguguaccugcagaugaacggccugagaggcgaggacaccgcccuguaccacugcgccaaggaccugagagagcuggagugcgagcuguggaccagcgacuacuacgacuucggcagaccccagcccugcaucgacagaagaggcgugagcggcaucugcgacauguggggccagggcaccauggugaucgugagcagc

SEQ ID NO: 32286 - RNA, 432 nt, Artificial Sequence
  derived and/or modified sequence opt4 from anti-HIV_cap256-206-028848_VR-Chain
caggagcagcugguggagagcggcggcggcguggugccccccggcaagagccugagacugagcugcguggccagcggcuucaccuucagcggcuucggcaugcacugggugagacaggcccccggcaagggccugcaguggguggccggcaucagcuucgccggcaccaaguacuacuacgaggacagcgugaagggcagauucaccaucagcagagacaacagcaagaacaccguguuccugcagaugaacggccugagaggcgacgacaccgcccuguacuacugcgugaaggacaugagagagcuggagugcgaggaguggaccagcgacuacuacgacuucggcaagccccagcccugcaucgacagaagaggcgugagcggcaucagcgccauguggggccagggcaccauggugaccaucagcagc

SEQ ID NO: 32287 - RNA, 432 nt, Artificial Sequence
  derived and/or modified sequence opt4 from anti-HIV_cap256-206-027652_VR-Chain
caggagcagcugguggugagcggcggcgacguggugccccccggcaagagccugagacugagcugcguggccagcggcuucaccuucagcgccuucggcaugcacugggugagacaggcccccggcaagggccuggaguggguggccagcaucagcuucgccggcaccaaguacuacuacgccgacagcgugaagggcagauucgccaucagcagagacaacagcaagaacacccuguuccugcagaugaacggccugagaagagaggacaccggccuguacuacugcgugaaggacaugagacagcuggagugcgaggaguggaccagcgacuacuacgacuucggcagaccccagcccugcaucgacagaagaggcgugagcggcaucagcgccauguggggccagggcaccauggugaccaucagcagc

SEQ ID NO: 32288 - RNA, 417 nt, Artificial Sequence
  derived and/or modified sequence opt4 from anti-HIV_cap256-206-024075_VR-Chain
caggagaagcugguggagagcggcggcggcgccgugcagcccggcggcagccugagacugagcugcguggccagcggcuucaccuucagcggcuucggcaugcacugggugagacaggcccccggcaagggccuggaguggcuggccaccaucagcuucagcggcgugaagaaguacuacggcaccagcgccaagggcagauucuacaucagcagagacaacaccaagaacaccguguaccugcagauggacggccugagaggcgacgacaccgccaucuacuacugcgccaaggaccugagauuccuggagugcggccuguggagcaccuacuacccccagcccugccuggacaccagaggcgugagcggcaucagcaacguguggggccccggcaccauggugaccgugagcagc

SEQ ID NO: 32289 - RNA, 417 nt, Artificial Sequence
  derived and/or modified sequence opt4 from anti-HIV_cap256-206-008748_VR-Chain
caggagaagcugguggagagcggcggcggcgccgugcagcccggcggcagccugagacugagcugcguggccagcggcuucaccuucaacggcuucggcaugcacugggugagacaggcccccggcaagggccuggaguggguggccaccaucagcuucagcggcgugaagaaguacuacggcaccagcgccaagggcagauucuucaucagcagagagaacagcaagaacacccuguaccugcagaugaacggccugagaggcgaggacaccgcccuguacuacugcgccaaggaccugagauaccuggagugcggcgaguggagcaccuacuacccccagcccugccuggacaccagaggcgugagcggcaucagcaacguguggggccccggcaccagagugaccgugagcagc

SEQ ID NO: 32290 - RNA, 432 nt, Artificial Sequence
  derived and/or modified sequence opt4 from anti-HIV_cap256-206-008530_VR-Chain
caggagcagcugguggagagcggcggcggcguggugccccccggcaagagccugagacugagcugcguggccagcggcuucagcuucggcgccuucggcaugcacugggugagacaggcccccggcaagggccuggaguggguggccggcaucagcuucgugggcaucaaguacuacuacgccgacagcgugaagggcagauucaccaucagcagagacaacagcaagaagacccuguuccugcagaugaacggccugagaggcgacgacaccgcccuguacuacugcgugaaggacaugagagagcuggagugcgaggaguggaccagcgacuacuacgacuucggcaagccccagcccugcaucgacagaagaggcgugagcggcaucagcgccuucuggggccagggcaccauggugaccaucagcagc

SEQ ID NO: 32291 - RNA, 432 nt, Artificial Sequence
  derived and/or modified sequence opt4 from anti-HIV_cap256-176-723043_VR-Chain
caggagcagcugguggagagcggcggcggcguggugccccccggcaagagccugagacugagcugcguggccagcggcuucaccuucagcgccuucggcaugcacugggugagacaggcccccggcaagggccuggaguggguggccggcgugagcuucgccggcaucaaguacuacuacgccgacagcgugaagggcagauucaccaucagcagagacaacagcaagaacacccuguuccugcagaugaacggccugagaggcgacgacaccgcccuguacuacugcgugaaggaccugagagagcuggagugcgaggaguggaccagcgacuacuacgacuucggcagaccccagcccugcaucgaccccagaggcgugagcggcaucagcgccauguggggccagggcaccguggugaccaucagcagc

SEQ ID NO: 32292 - RNA, 432 nt, Artificial Sequence
  derived and/or modified sequence opt4 from anti-HIV_cap256-176-600049_VR-Chain
gaggugcagcuggugcagagcggcggcggcguggugcagcccggcagaagccugagacugagcugcgccgcccccuacuucgaguucggcagauacggcuuccacugggugagacaggcccccggcaagggccuggaguggguggccagcaucagcuucgccggcagaggcuacuaccacagccccagcguguggggcagauucaccaucagcagagacaacagcaagaacacccuguaccugcagaugaacagccugagaaucgaggacaccgcccuguacuucugcgccagagaccugagagagagcgagugcgaggagugggagagcgacuacuacgacuucggcaagaagggccccugcgugaagcccagaggcguggccggcggccuggaccuguggggccagggcaccauggugaucgugagcagc

SEQ ID NO: 32293 - RNA, 432 nt, Artificial Sequence
  derived and/or modified sequence opt4 from anti-HIV_cap256-176-531926_VR-Chain
caggugcagcugguggagagcggcggcggcguggugccccccggcaagagccugacccugagcugcguggccagcagauucaccuucagcgccuucggcaugcacugggugagacaggcccccggcaagggccuggaguggguggccggcaucagcuucgugggcaucagaaaguacuacgccgacagcgugaagggcagauucagcaucagcagagacaacagcaagaacaccguguuccuggagaugaacggccugagaggcgaggacaccggccuguacuacugcgugaaggacaugagagagcuggagugcgaggagugggccagcgacuacuacgacuucggcaagccccagcccugccuggacagaagaggcgugagcggcaucagcgccauguggggccagggcacccuggugaucaucagcagc

SEQ ID NO: 32294 - RNA, 432 nt, Artificial Sequence
  derived and/or modified sequence opt4 from anti-HIV_cap256-176-504134_VR-Chain
gaggugcagcugguggagagcggcggcggcguggugccccccggcaagagccugagacugagcugcgugaccagcagacuggccuucggcgccuucggcaugcacugggugagacaggcccccggcaagggccuggaguggguggccagcaucagcuucgccggcaucaagaaguacuacgccgacagcgugaagggcagauucaccaucagcagagacaacagcaaggacaccguguuccuggagaugaacggccugagaggcgacgacaccggccuguacuacugcgugaaggacaugagauaccuggagugcgaggagugggccagcgacuacuacgacuucggcagaccccagcccugccuggaccccagaggcgugagcggcaucagcgccauguggggccagggcacccuggugaucaucagcagc

SEQ ID NO: 32295 - RNA, 432 nt, Artificial Sequence
  derived and/or modified sequence opt4 from anti-HIV_cap256-119-186229_VR-Chain
cagaugcagcugguggagagcggcggcggcguggugcagcccggcggcagccugagacugcugugcagcgccagcggcuucaccuucagcaccuacggcaugcacugggugagacaggcccccggcaagggccuggaguggguggccagcaucagcuacgacggcagcgacaaguaccacgccggccugguguggggcagauucaucaucagcagagacaacagcaagaacacccuguaccugcagaugaacagccugagagccgaggacaccgcccuguacuacugcgugagagacgagagagagagcgagugcgagcugugggagagcgacuacuacaacuucggcaagaagcugcccugcgugaagcccagaggcguggccggcacccuggacaucuggggccagggcaccaccgugaucgugagcagc

SEQ ID NO: 32296 - RNA, 432 nt, Artificial Sequence
  derived and/or modified sequence opt4 from anti-HIV_cap256-119-183891_VR-Chain
caggugcagcugguggagagcggcggcggcguggugcagcccggcggcagccugagacugagcugcgccgccagcggcuucaccuucagcagcuacggcaugcacugggugagacaggcccccggcaagggccuggaguggguggccuucaccagauacgacggcagcgacaaguacuaccuggacagcgugaagggcagauucaccaucagcagagacaacagcaaguacacccuguuccugcagauggugagccugagaaccgaggacaccgcccuguacuucugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32297 - RNA, 435 nt, Artificial Sequence
  derived and/or modified sequence opt4 from anti-HIV_cap256-119-183631_VR-Chain
caggugcagcuggugcagagcggcggcggcguggugcagcccggcagaagccugagacugagcugcgccgccagcaaguucaccuucagcaccuacacccugcacugggugagacaggcccccggcaagggccuggaguggguggccgugaucagccacgacggcggcaacagauucuacgccgacagcgugaagggcagauucaccaucagcagagacaacagcaagaacaaccuguuccugcagaugaacagccugagaguggaggacaccgcccuguacuacugcgccagagaccugagagagauggagugcgaggaguggacccuguacaacuacuacgacuucggcagcagaggccccugcguggaccccagaggcguggugggcagcuucgacguguggggccagggcaccauggugaccgugagcagc

SEQ ID NO: 32298 - RNA, 432 nt, Artificial Sequence
  derived and/or modified sequence opt4 from anti-HIV_cap256-119-182676_VR-Chain
caggugcagcugguggagagcggcggcggcguggugcagcccggcaagagccugagacugagcugcguggugagcggcuucaccuucagcaacuaccccaugcacugggugagacaggcccccggcaagggccuggaguggguggccagcaucagcuucgccggcaucaagaaguacuacggcgacagcgugaagggcagauucaccaucagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32299 - RNA, 432 nt, Artificial Sequence
  derived and/or modified sequence opt4 from anti-HIV_cap256-119-180772_VR-Chain
caggugcagcugguggagagcggcggcggcguggugcagcccggcagaagccugagacugagcugcgccgccagcgaguucaccuucagcaacuacgccaugcacugggugagacaggcccccggcaagggccuggaguggguggccagcaucagcuucgacggcagagacaaguaccacagcagccugguguggggcagacugaccaucagcagagacaacagcaagagcacccuguuccugcagaugaacagccugagacccgaggacaccgcccuguacuacugcgccagagacgugagagagagcgagugcgaggaguggcagagcgacuacuacgccuucuacagaaagcugcccugcgugaagcccagaggcguggccggcacccuggacaucuggggccagggcaccauggugaccgugagcagc

SEQ ID NO: 32300 - RNA, 435 nt, Artificial Sequence
  derived and/or modified sequence opt4 from anti-HIV_cap256-119-180508_VR-Chain
caggugcaccugguggagagcggcggcggcguggugcagcccggcagaagccugagacugagcugcgccgccagccacuucagccugagcagcuacggcaugcacugggugagacagacccccggcaagggccuggaguggguggccggcaucagcuucgccggcgugaagaccuacuacggcaccagcgugaagggcagauucaccaucagcagagacaacagcaagaacaaccuguaccugcagaugaacagccugagacccgaggacaccgcccuguacuacugcgccagagaccugagagagauggagugcgaggaguggaagcuguacaacuacuacgacuucagaaccagaggccccugcguggaccccagaggcguggugggcagcuucgacguguggggccagggcaccguggugaccgugagcagc

SEQ ID NO: 32301 - RNA, 432 nt, Artificial Sequence
  derived and/or modified sequence opt4 from anti-HIV_cap256-119-180260_VR-Chain
gaggugcagcugguggagagcggcggcggcguggugagacccggcggcagccugagacugagcugcgccgccagccaguucaccuucagcaacuucggcaugcacugggugagacaggcccccggcaagggccuggaguggguggccagcaucagcuucgugggcaucaagacccacuacgccaacagcgugagaggcagauucaccaucagcagagaccagagcaagaacacccuguaccugcagaugaacagcgugagaguggaggacaccggcagauacuacugcgccagagacaugagagaguacgagugcgagcugugggccagcgacuacuacgacuucggcaagccccagcccugcgaggaccccagaggcguggugggcaccuucgacauguggggccugggcacccuggugaccgugagcagc

SEQ ID NO: 32302 - RNA, 432 nt, Artificial Sequence
  derived and/or modified sequence opt4 from anti-HIV_cap256-119-180173_VR-Chain
gaggugcagcugguggagagcggcggcggccuggugcagcccggcggcagccugagacugagcugcgccgccagcggcuucaccgugagcagcaacuacaugagcugggugagacaggcccccggcaagggccuggaguggguggccagcaucagcuucgccggcaccaagaagcacuacggcaacagcgugaagggcagauucaccaucagcagagacaacagcaagaacacccuguaccugcagaugaacagccugagaggcgaggacaccgcccuguacuacugcgccaaggaccugagagaguacgagugcgaggaguggaccagcgacuacuacgacuucggcagaccccagcccugcaucgacagcagaggcguggugggcauccuggacaucuggagccagggcaccauggugaccgugagcagc

SEQ ID NO: 32303 - RNA, 432 nt, Artificial Sequence
  derived and/or modified sequence opt4 from anti-HIV_cap256-119-179839_VR-Chain
caggugcagcugguggagagcggcggcggcguggugcagcccggcagaagccugagacugagcugcgccgccagcggcuucagcuucggcaccagcgacgugcacugggugagacaggcccccggcgagggccuggaguggguggcccugaucagcuucgacggcagacagaaggaccuggccgacagcgugagaggcagauucaccaucagcagagacagcagcaagaacacccuguaccuggagaugaacagccugagacccgaggacaccgcccuguacuacugcgccaaggacaugagaggcuacgagugcgaggaguggaccagcgacuacuacgacuucggcagaccccagcccugcaucgacagcagaggcguggugggcaccuucgacguguggggccagggcaccauggugaccgugagcagc

SEQ ID NO: 32304 - RNA, 423 nt, Artificial Sequence
  derived and/or modified sequence opt4 from anti-HIV_cap256-119-179262_VR-Chain
caggugcagcugguggagagcggcggcagaguggugcagagcggcggcagccugagacugagcugcggcgccagcggcuucagcuucaccaccagcgccaugcacugggugagacaggcccccggcaagggccuggaguggguggccaucaacggcgccaacaagcacuacgccgagagcgugaagggcagauucaccaucagcagagacaacagcaagaacacccuguuccuggagaugaacagccugagacccgacgacaccgcccuguacuucugcgugaaggaccagagagaggacgagugcgaggagugguggagcgacuacuacgacuucggcagagagcagcccugccuggaccccagaggcguggugggcaucuucgaccuguggggccagggcaccauggugaccgugagcagc

SEQ ID NO: 32305 - RNA, 432 nt, Artificial Sequence
  derived and/or modified sequence opt4 from anti-HIV_cap256-119-178995_VR-Chain
caggugcagcugguggagagcggcggcggcguggugcagcccggcaagagccugagacugagcugcgccgccagcggcuucacccugaccagauucgccaugcacugggugagacaggcccccggcaagggccuggaguggguggccgugaucugguacgacggcagcaacaaguacuacgccgacagcgugaagggcagauucaccgugagcagagacaacagcaagaacacccuguaccugcagaugaacagccugagaaccgaggacaccgcccuguacuacugcgugagagacagaagagagagcgagugcgagcugugggagagcgacuacuacaacuucggcagaagacugcccugcgugaagcccagaggcguggccggcauccuggacaucuggggccagggcaccaccgugaccgugagcccc

SEQ ID NO: 32306 - RNA, 432 nt, Artificial Sequence
  derived and/or modified sequence opt4 from anti-HIV_cap256-119-178455_VR-Chain
gaggugcagcugguggagagcggcggcggccuggugcagcccggcggcagccugagacugagcugcguggugagcggcuucaccuucagcaacuucuggaugagcugggugagacaggcccccggcaagggccuggaguggguggccagcaucagcuacgacggcagagacaaguaccacagcagccugguguggggcagacugaccaucagcagagacaacagcaagagcacccuguuccugcagaugaacagccugagagccgaggacaccgcccuguacuacugcgccagagaccugagagagagcgagugcgaggaguggcagagcgacuacuacgccuucuacaagaagcugcccugcgugaagcccagaggcguggccggcacccuggacaucuggggccagggcaccauggugaccgugagcagc

SEQ ID NO: 32307 - RNA, 438 nt, Artificial Sequence
  derived and/or modified sequence opt4 from anti-HIV_cap256-119-177993_VR-Chain
caggugcaccugguggagagcggcggcggcguggugcagcccggcaagagccugagaaucuacugcgccgugagcgaguucaccuucagcaacuacgccaugcacugggugagacuggcccccggcagaggccugcaguggcuggccgugaucagcuacgacggcagcaagaaguacuacgccgacagccuggagggcagauucaccaucagcaaggacaacagcaagaacacccuguuccugcagaugaacagccugagaguggaggacaccgcccuguacuucugcgugaaggaccagagagaggacgagugcgaggagugguggagcgacuacuacgacuucggcgagagagccccccugcccaaggugcccggccccggccccggcuggaaccuggacauguggggccacggcaccauggugaccgugagcagc

SEQ ID NO: 32308 - RNA, 438 nt, Artificial Sequence
  derived and/or modified sequence opt4 from anti-HIV_cap256-119-177727_VR-Chain
caggugcagcugguggagagcggcggcggcguggugcagcccggcagaagccugagacugagcugcgccgccagcggcuucacccugagcagauacgacaugcacugggugagacaggcccccggcaagggccuggaguggguggccagcaucagcaaggacggcaccaagaaguaccacggcgacagcguguggggcagauucaucaucagcagagacaacagcaagaacacccuguuccugcagaugagcagccugagagccgaggacaccgcccuguacuucugcgugagagaccagagagaggccgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32309 - RNA, 432 nt, Artificial Sequence
  derived and/or modified sequence opt4 from anti-HIV_cap256-119-176746_VR-Chain
gaggugcagcugguggagagcggcggcggccuggugcagcccggcggcagccugagacugagcugcgccgccagcgacuucaccuucgacgacuacgccaugcacugggugagacaggcccccggcaagggccuggagugggugggcggcaucagcuacgacggcagcgacaaguaccacaccaacagcguguggggcagauucaucgugagcagagacaacagcaagaacacccuguaccugcagaugaacagccugagacccgaggacaccgcccuguacuacugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32310 - RNA, 432 nt, Artificial Sequence
  derived and/or modified sequence opt4 from anti-HIV_cap256-119-176241_VR-Chain
caggugcagcugguggagagcggcggcggcguggugcagcccggcagaagccugagacugagcugcgccgccagcggcuucaccuucagcaacuacgccaugcacugggugagacaggcccccggcaagggccuggaguggguggccgugaucagcuacgacggcagcaacaaguacuacgccgacagcgugaagggcagauucaccaucagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32311 - RNA, 432 nt, Artificial Sequence
  derived and/or modified sequence opt4 from anti-HIV_cap256-119-175215_VR-Chain
caggugcagcugguggagagcggcggcggcguggugcagcccggcagaagccugagacugagcugcgccgugagccaguucaccuucggcagauacggcauguacugggugagacaggcccccggcaagggccuggaguggguggccggcaucagcuacgacggcagcgacaaguaccacaccaacagcguguggggcagauucaucgugagcagagacaacagcaagaacaugcuguaccugcagaugaacaaccugagacccgaggacaccgcccuguacuacugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32312 - RNA, 432 nt, Artificial Sequence
  derived and/or modified sequence opt4 from anti-HIV_cap256-119-173928_VR-Chain
ggcguggagcugcuggagagcggcggcggccugguggagcccggcggcagccugagacugagcugcgugggcagccaguucagcuucgacagauacggcaugcacugggugagacaggcccccggcaagggccuggaguggguggccgccgugagcuucgacggcaccgacaaguaccacgccgacgacguguggggcagauucaccaucagcagagacaacagcaagaacacccuguaccugcagaugaacagccugagagccgaggacaccgcccuguacuacugcgccaaggaccugagagaggacgagugcgaggagugguggagcgacuacuacgaccugggcaagcagcugcccugcagaaagagcagaggcguggccggcgugcuggacaaguggggccugggcaccauggugaccgugagcagc

SEQ ID NO: 32313 - RNA, 432 nt, Artificial Sequence
  derived and/or modified sequence opt4 from anti-HIV_cap256-119-173495_VR-Chain
caggugcagcugguggagagcggcggcggcguggugcagcccggcaagagccugagacugagcugcgccgccagcagauucaccuucaacagauacggcaugcacugggugagacaggcccccggcaagggccuggaguggguggccgccaucagcuucgacggcaccgacaaguaccacagcgacgacguguggggcagauucaccaucagcagagacaacagcaagaacacccuguaccugcagaugaacagccugagagccgaggacaccgccguguacuacugcgccaaggaccugagagaggacgagugcgaggagagauggagcgacuacuacgacuucggcaagcagcugcccugcagaaagagcagaggcguggccggcaucuucgacaacuggggccagggcaccauggugaccgugagcagc

SEQ ID NO: 32314 - RNA, 432 nt, Artificial Sequence
  derived and/or modified sequence opt4 from anti-HIV_cap256-119-172882_VR-Chain
caggugcagcugguggagagcggcggcggcguggugcagcccggcagaagccugacccugagcugcgaggugagcggcuucaccuucaagaccuacggcaugcacugggugagacaggcccccggcaagggccuggaguggguggccagcaucagcuacgacggcagcgacaaguaccacgccgacagaguguggggcagauucaccaucagcagagacaacagcaagaacacccuguaccugcagaugaacagccugagagccgaggacaccgcccuguacuacugcgugagagacgccagagagagcgagugcgagcugugggagagcgacuacuacaacuucggcagaaagcugcccugcgugaagcccagaggcguggccggcacccuggacaucuggggccagggcaccauggugaccgugagcagc

SEQ ID NO: 32315 - RNA, 432 nt, Artificial Sequence
  derived and/or modified sequence opt4 from anti-HIV_cap256-119-172429_VR-Chain
gaggugcagcugguggagaccggcggcggccugauccagcccggcggcagccugagacugagcugcguggccagccaguucaccuucagcggcugcggccugcacugggugagacaggcccccggcaagggccuggaguggguggccagcaucagcuucgccggcaccaagaagcacuacggcaacagcgugaagggcagauucaccaucagcagagacaacagcaagaacacccuguaccuggagaugaacacccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugagcgugagcagc

SEQ ID NO: 32316 - RNA, 432 nt, Artificial Sequence
  derived and/or modified sequence opt4 from anti-HIV_cap256-119-172223_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgugaucagcuacgacggcagagacuucuaccacgccagaagcguguggggcagauucaccaucagcagagacaacagcaagaacacccugcaccugcagaugaacagccugagacccgaggacaccgcccuguacuucugcgccagagaccugagagagagcgagugcgaggagugggagagcuacuacuacgacuucggcaagaaggaccccugcgugaagcccagaggcguggugggcgugcuggacaucuggggccagggcacccuggugaccgugagcagc

SEQ ID NO: 32317 - RNA, 432 nt, Artificial Sequence
  derived and/or modified sequence opt4 from anti-HIV_cap256-119-171838_VR-Chain
caggugcagcugggcgagagcggcggcggcguggugcagcccggcagaagccugagacugagcugcgccgccagcggcuucaccuucagcaccuucgccaugcacugggugagacaggcccccggcaagggccuggaguggguggccgugaucagcuacgacggcagcaacaaguacuacgccgacagcgugaagggcagauucgccaucagcagagacaacgccaagaaccugcugcaccugcagaugaacagccugagacccgaggacaccgcccuguacuacugcgccaaggaccugcaggaggacgagugcgaggagugguggagcgacuacuacgacuucggcaagcagcugcccugcagaaagagcagaggcguggccggcaucuucgacgacuggggccagggcaccauggugaccgugagcagc

SEQ ID NO: 32318 - RNA, 432 nt, Artificial Sequence
  derived and/or modified sequence opt4 from anti-HIV_cap256-119-171587_VR-Chain
gaggugcagcugguggagagcggcggcggccuggugcagcccggcggcagccugagacugagcugcgccgccagcggcuucaccuucagcgacuacuacaugagcuggaucagacaggcccccggcaagggccuggaguggguggccagcaucagcuucgccggcaccaagcagcacuacggcaacagcgugaagggcagauucaccaucagcagagacaacagcaagaacaccguguaccugcagaugaacagccugagacuggaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32319 - RNA, 432 nt, Artificial Sequence
  derived and/or modified sequence opt4 from anti-HIV_cap256-119-169596_VR-Chain
cuggugcagcugguggagagcggcggcggcguggugcagcccggcagaagccugagacugagcugcaccgccagcggcuucaccuucagcagcuucgccaugcacagagugagacagacccccggcaagggccuggaguggguggccagcaucagcuacgacggcagcgacaaguaccacgccgacagaguguggggcagauucaccaucagcagagacaacagcaagaacacccuguaccugcagaugaacagccugagagccgaggacaccgcccuguacuacugcgugagagacgccagagagagcgagugcgagcugugggagagcgacuacuacaacuucggcagaaagcugcccugcgugaagcccagaggcguggccggcacccuggacaucuggggccagggcaccauggugaccgugagcagc

SEQ ID NO: 32320 - RNA, 432 nt, Artificial Sequence
  derived and/or modified sequence opt4 from anti-HIV_cap256-119-169523_VR-Chain
caggugcagcugguggagagcggcggcggcguggugcagcccggcgagagccugagacugagcugcgccgccagcggcuucagcuucggcaccagcgacgugcacugggugagacaggcccccggcgagggccuggaguggguggccagcaucagcuucgccggcaucaagaaguacuacggcgacagcgugaagggcagauucaccaucagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32321 - RNA, 432 nt, Artificial Sequence
  derived and/or modified sequence opt4 from anti-HIV_cap256-119-169462_VR-Chain
gaggugcagcugguggagagcggcggcggccuggugcagcccggcggcagccugagacugagcugcgccgccagcggcuucaccuucaccaccuacagccugcacugggugagacagagccccggcaagggccuggaguggguggccgccaucagcuucgccggcaccaaggagaacuacgccaacagcgugagaggcagauucaccaucagcagagacaacagcaagaacacccuguaccugcagaugaacagccugagagccgaggacaccgcccuguacuacugcaccaaggacaugagagaguacgagugcgaggaguggaccagcgacuacuacgacuucggcagaccccagcccugcaucgacagcagaggcguggugggcaccuucgacguguggggccagggcaccauggugaccgugagcagc

SEQ ID NO: 32322 - RNA, 432 nt, Artificial Sequence
  derived and/or modified sequence opt4 from anti-HIV_cap256-119-169092_VR-Chain
gaggugcagcugguggagagcggcggcggccuggugcagcccggcggcagccugagacugagcugcgugaucagcggcuucaccuucagcagcuacgagaugaacugggugagacaggcccccggcaagggccuggaguggguggccggcaucagcuacgacggcagagacaaguaccacgcccacuucguguggggcagaaucaccaucagcagagacaacagcaagaacacccuguaccugcagaugaacagccugagagccgaggacaccgcccuguaccacugcgugagagaccugagagagagcgagugcgagcugugggagagcgacuacuacgacuucggcaagaagcugcccugcgugaagcccagaggcguggccggcaucuucgaccuguggggccagggcaccauggugaccgugagcagc

SEQ ID NO: 32323 - RNA, 432 nt, Artificial Sequence
  derived and/or modified sequence opt4 from anti-HIV_cap256-119-168680_VR-Chain
caggugcagcugguggagagcggcggcggcguggugcagcccggcagaagccugagagugagcugcgccgccagccacuucaccuucagcagauacggcaugcacugggugagacaggcccccggcaagggccuggaguggguggccagcaucagcuacgacggcagagacuucuaccacgccagaagcguguggggcagauucgccaucagcagagacaacagcaagaacacccugcaccugcagaugaacagccugagaaccgaggacaccgcccuguaccacugcgugagagaccugagagagagcgagugcgagcugugggagagcgacuacuacgacuucggcaagaagcugcccugcgugaagcccagaggcguggccggcaccuucgaccuguggggccagggcaccauggugaccgugagcagc

SEQ ID NO: 32324 - RNA, 438 nt, Artificial Sequence
  derived and/or modified sequence opt4 from anti-HIV_cap256-119-166385_VR-Chain
caggugcagcugguggagagcggcggcggcguggugcaccccggcagaagccugagacugagcugcgccgccagcggcuucagcuucggcaacuucggcaugcacugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32325 - RNA, 432 nt, Artificial Sequence
  derived and/or modified sequence opt4 from anti-HIV_cap256-119-165943_VR-Chain
gaggugcagcugguggagagcggcggcggccuggugcagcccggcagaagccugagacugagcugcgccgugagcggcuucaccgugagcagcaacuacaugagcugggugagacaggcccccggcaagggccuggaguggguggccagcaucagcuucgccggcaucaagaaguacuacggcgacagcgugaagggcagauucaccaucagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32326 - RNA, 432 nt, Artificial Sequence
  derived and/or modified sequence opt4 from anti-HIV_cap256-119-165738_VR-Chain
gaggugcagcugguggagagcggcggcggccuggugcagcccggcagaagccugagacugagcugcgccgccagcggcuucaccuucgacgacuacgccaugaacugggugagacaggcccccggcaagggccuggaguggguggccaccaucagcuucgacggcaccgacaaguaccacgccgacgacguguggggcagauucaccaucagcagagacaacagcaagaagacccuguaccugcagaugaacagccugagagccgaggacaccgcccuguacuacugcgccaaggaccugagagaggacgagugcgaggagugguggagcgacuacuacgaccugggcaagcagcugcccugcagaaagagcagaggcguggccggcgugcuggacaaguggggccugggcaccauggugaccgugagcagc

SEQ ID NO: 32327 - RNA, 432 nt, Artificial Sequence
  derived and/or modified sequence opt4 from anti-HIV_cap256-119-164913_VR-Chain
caggaccaccugguggagagcggcggcggcggcgugcagcccggcaagagccugagacugagcugcgccgccagcggcuucaccuucagcgcccacgccaugcacugggugagacaggcccccggcaagggccccgaguggguggccgugaucagccacgacggcggccagcaguucuacagagagagcgugaagggcagauucaccaucagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32328 - RNA, 432 nt, Artificial Sequence
  derived and/or modified sequence opt4 from anti-HIV_cap256-119-164167_VR-Chain
gaggugagacugguggagagcggcggcggccugauccagcccggcggcagccugagacugagcugcgccgccagcggccugaccgugagcagcaaccacaugagcugggugagacaggcccccggcaagggccuggaguggguggccagcaucagcuacgacggcagagacuucuaccacgccagaagcguguggggcagauucaccaucagcagagacaacagcaagaacacccugcaccugcagaugaacagccugagacccgaggacaccgcccuguacuucugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32329 - RNA, 432 nt, Artificial Sequence
  derived and/or modified sequence opt4 from anti-HIV_cap256-119-163558_VR-Chain
cagaugcagcugguggagagcggcggcggcguggugcagcccggcagaagccugacccugagcugcgccgccagccaguucaacuucgccaacuacggcaugcacugggugagacaggcccccggcaagggccuggaguggguggccagcaucagcuacgacggcagcgacaaguaccacgccgacagaguguggggcagauucaccaucagcagagacaacagcaagaacacccuguaccugcagaugaacagccugagagccgaggacaccgcccuguacuacugcgugagagacgccagagagagcgagugcgagcugugggagagcgacuacuacaacuucggcagaaagcugcccugcgugaagcccagaggcguggccggcacccuggacaucuggggccagggcaccauggugaccgugagcagc

SEQ ID NO: 32330 - RNA, 432 nt, Artificial Sequence
  derived and/or modified sequence opt4 from anti-HIV_cap256-119-162043_VR-Chain
caggugcagcugguggagagcggcggcggcguggugcagcccggcagaagccugagagugagcugcgccgccagccacuucaccuucagcagauacggcaugcacugggugagacaggcccccggcaagggccuggagugggugaccggcaucagcuucgccgccaccaagaccuacuacggcgacagcgugagaggcagauucaccgugagcagagacaucagcaagaacacccuguaccugcagaugaacagccugagacccgaggacaccgccauguacuacugcgccagagaccagagauacuacgagugcgaggagugggccagcgacuacuacgacuucggcagagagcagcccugccaggaccccagaggcguggugggcauccuggaccuguggggccagggcaccauggugaccgugagcagc

SEQ ID NO: 32331 - RNA, 432 nt, Artificial Sequence
  derived and/or modified sequence opt4 from anti-HIV_cap256-119-161718_VR-Chain
caggugcagcugguggagagcggcggcggcguggugcagcccggcaagagccugagacugagcugcgccgccagccacuucagcuucaacagauacggcaugcacugggugagacaggcccccggcaagggccuggaguggguggccgccaucagcuacgacggcaccgacaaguaccacgccgaccagguguggggcagauucaccaucagcagagacaacagcaagaacacccuguaccugcagaugaacagccugagacccgaggacaccgcccuguacuacugcgccaaggaccugagagaggacgagugcgaggagugguggagcgacuacuacgaccugggcaagcagcugcccugcagaaagagcagaggcguggccggcaucuucgacaaguggggccagggcaccauggugaccgugagcagc

SEQ ID NO: 32332 - RNA, 432 nt, Artificial Sequence
  derived and/or modified sequence opt4 from anti-HIV_cap256-119-161675_VR-Chain
caggugcagcugguggagagcggcggcggcguggugcagcccggcagaagccugagacugagcugcaccgccagcggcuucaccuucagcaucuacagcaugaacugggugagacaggcccccggcaagggccuggacuggguggccggcaucagcuucgccgccaccaagaccuacuacggcggcagcgugaagggcagauucaccgugagcagagacaucagcaagaacacccuguaccugcagaugaacagccugagacccgaggacaccgccauguacuacugcgccagagaccagagauacuacgagugcgaggagugggccagcgacuacuacgacuucggcagagagcagcccugccaggaccccagaggcguggugggcguguucgacauguggggccagggcaccauggugaccgugagcagc

SEQ ID NO: 32333 - RNA, 432 nt, Artificial Sequence
  derived and/or modified sequence opt4 from anti-HIV_cap256-119-161053_VR-Chain
caggugcaccugguggagagcggcggcggcguggugcagcccggcaccagccugagacugagcugcguggccagcggcuucaccuucagcaacuucgccaugcacugggugagacaggcccccggcaagggccuggagugggccgccaucaucagcaccagaggcaacaacagaaacuacgccgacagcgugagaggcagauucaccgugagcagagacaucagcaagaacacccuguaccugcagaugaacagccugagacccgaggacaccgccauguacuacugcgccagagaccagagauacuacgagugcgaggagugggccagcgacuacuacgacuucggcagagagcagcccugccaggaccccagaggcguggugggcauccuggaccuguggggccagggcaccauggugaccgugagcagc

SEQ ID NO: 32334 - RNA, 432 nt, Artificial Sequence
  derived and/or modified sequence opt4 from anti-HIV_cap256-119-159499_VR-Chain
caggugcagcugguggagagcggcggcggcguggugcagcccggcagaagccugagacugagcugcgccgccagcggcuucgccuucagccacuacggcaucuucugggugagacaggcccccggcaagggccuggaguggguggccagcaucagcuucgacggcagagacuacuaccacagcccccacguguggggcagacugaccaucagcagagacaacagcaagaacacccuguaccugcagaugaacagccugagagccgaggacaccgcccuguacuacugcgccagagaccugagagagagcgagagagaggagugggagagcgacuacuacgacuucggcaagaagggccccugcgugaagcccagaggcguggccggcagccuggacauguggggccagggcaccauggugaucgugagcagc

SEQ ID NO: 32335 - RNA, 432 nt, Artificial Sequence
  derived and/or modified sequence opt4 from anti-HIV_cap256-119-159114_VR-Chain
gaggugcagcugguggagagcggcggcggccuggugcagcccggcggcagccugagacuggccugcgccgccagcggccugaccuucagaaagcacggcaugcacugggugagacaggcccccggcaagggccuggagugggugagcuacaucagcagcgacggcgugaacaacuaccugaucgacagcgugagaggcagauucaccgugagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32336 - RNA, 432 nt, Artificial Sequence
  derived and/or modified sequence opt4 from anti-HIV_cap256-119-156751_VR-Chain
gaggugcagcugcuggagagcggcggcggccuggugcagcccggcggcagccugagacugagcugcgccgccagcggcuucgccuucagcagcuacggcaugcacugggugagacaggcccccggcaagggccuggaguggguggccagcaucagcuacgacggcagagacuucuaccacgccagaagcguguggggcagauucaccaucagcagagacaacagcaagaacacccugcaccugcagaugaacagccugagacccgaggacaccgcccuguacuucugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32337 - RNA, 432 nt, Artificial Sequence
  derived and/or modified sequence opt4 from anti-HIV_cap256-119-155656_VR-Chain
gaggugcagcugguggagagcggcggcggccuggugcagcccggcggcagccugagacugagcugcgccgccagcggcaucaccuucagcagcuacggcaugcacugggugagacaggcccccggcaagggccuggaguggguggccuucaucagauacgacggcagcagcaaguacuacgccgacagcgugaagggcagauucaccaucagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32338 - RNA, 432 nt, Artificial Sequence
  derived and/or modified sequence opt4 from anti-HIV_cap256-119-154420_VR-Chain
caggugagacugguggagagcggcggcggcguggugcagcccggcagaagccugagaaucagcugcgccgccagccaguucauguucagcagauacggcaugcacugggugagacaggcccccggcaagggccuggaguggguggccagcaucagcuacgacggcaccgacaaguaccacgccgaccugguguggggcagauucaccaucagcagagacaacagcaagaacacccuguaccugcagaugaacagccugagagccgaggacaccgcccuguacuacugcgccagagaccugagagagagcgagugcgaggagugggagagcgacuacuacgacuucggcaagaagggccccugcgugaagcccagaggcguggccggcagccuggacauguggggccagggcaccauggugaucgugagcagc

SEQ ID NO: 32339 - RNA, 432 nt, Artificial Sequence
  derived and/or modified sequence opt4 from anti-HIV_cap256-119-153954_VR-Chain
gaggugcaggugcuggagagcggcggcggccuggugcagcccggcggcagccugagacugagcugcguggccagccaguucaccuucagcggcugcggccugcacugggugagacaggcccccggcaagggccuggaguggguggccagcaucagcuucgccggcaccaagaagcacuacggcaacagcgugaagggcagauucaccaucagcagagacaacagcaagaacaccguguaccuggagaugaacagccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32340 - RNA, 432 nt, Artificial Sequence
  derived and/or modified sequence opt4 from anti-HIV_cap256-119-153864_VR-Chain
caggugcaccugguggagagcggcggcggcguggugcagcccggcggcagccugagacugagcugcgccgccagcggcuucaccuucagcggcugcggccugcacugggugagacaggcccccggcaagggccuggaguggguggccagcaucagcuucgccggcaccaagaagcacuacggcagcagcgugagaggcagauucagcaucagcagagacaacagcaagaacacccuguaccugcagaugaacagccugagaaccgaggacaccgcccuguacuucugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32341 - RNA, 432 nt, Artificial Sequence
  derived and/or modified sequence opt4 from anti-HIV_cap256-119-153793_VR-Chain
gaggugcagcugguggagagcggcggcggcguggugcagcccggcggcagccugagacugagcugcgccaccagcggcuucaccuucggcaccuucggcaugcacugggugagacaggcccccggcaagggccuggacuggguggccuacaucagauacgacggcaagaccaagaacuacggcgagagcgugaagggcagauucaccaucagcagagacaacagcaagaacaccaugagccugcagaugaacagccugagacccgaggacaccgcccuguacuacugcgccaaggaccugagagaggacgagugcgaggagagauggagcgacuacuacgacuucggcaagcagcugcccugcagaaagagcagaggcguggccggcguguucgacaacuggggccagggcaccauggugaccgugagcagc

SEQ ID NO: 32342 - RNA, 432 nt, Artificial Sequence
  derived and/or modified sequence opt4 from anti-HIV_cap256-119-153462_VR-Chain
caggugcagcugguggagagcggcggcggcguggugcagcccggcggcagccugagacugagcugcgccgccagcggcuucaccuucagcaacuacggcaugcagugggugagacaggcccccggcaagggccuggaguggguggccgccaucagcuacgacggcagaaacgaguacuacgccgagagcgugaagggcagauucaccaucagcagagacaacuucaagagcacccuguuccugcagaugaacagccugagagccgaggacaccgcccuguacuacugcgccagagaccugagagagagcgagugcgaggagugggagagcgacuacuacgccuucuacagaaagcugcccugcgugaagcccagaggcguggccggcacccuggacaucuggggccagggcaccauggugaccgugagcagc

SEQ ID NO: 32343 - RNA, 438 nt, Artificial Sequence
  derived and/or modified sequence opt4 from anti-HIV_cap256-119-153124_VR-Chain
caggugcagcugguggagagcggcggcggcguggugcagcccggcagaagccugacccugagcugcaucgccagccaguucaacuucgccagcuacggcaugcacugggugagacaggcccccggcaagggccuggaguggguggccagcaucagccacgacggcaccaagaaguaccacgccgagagcguguggggcagauucaccaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32344 - RNA, 438 nt, Artificial Sequence
  derived and/or modified sequence opt4 from anti-HIV_cap256-119-153025_VR-Chain
cagaugcagcugguggagagcggcggcggcguggugcagcccggcaagagccugacccugagcugcgccgccagccaguucaccuucagcaacuacggcaugcacugggugagacaggcccccggcaagggccuggaguggguggccagcaucagcaacgacggcaacaagaaguaccacggcgacagcguguggggcagacugaccaucagcagagacaacagcaagaacacccuguuccugcagaugaacagccugagacccgaggacaccgcccuguacuucugcgugaaggaccagagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32345 - RNA, 432 nt, Artificial Sequence
  derived and/or modified sequence opt4 from anti-HIV_cap256-119-152713_VR-Chain
gaggugcagcugguggagagcggcggcggccuggugagacccggcggcagccugagacugagcugcgccaccagcggcuucaccuucagcagccacuggaugagcugggugagacaggcccccggcaagggccuggaguggguggccggcaucagcuucgccggcaccaagaccuacuacggcgacagcgugaagggcagauucaccgugagcaccgacaucagcaagaacacccuguaccugcaggugaacagccugagacccgaggacaccgccauguacuacugcgccagagaccagagauacuacgagugcgaggagugggccagcgacuacuacgacuucggcaaggagcagcccugccuggaccccagaggcguggugggcaucuucgacaucuggggccagggcaccauggugaccgugagcagc

SEQ ID NO: 32346 - RNA, 438 nt, Artificial Sequence
  derived and/or modified sequence opt4 from anti-HIV_cap256-119-151794_VR-Chain
cacgugcagcugguggagagcggcggcggcguggugcagcccggcaccagccugagacugagcugcguggccagcgaguucagcuucaagaacuacggcaugcacugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32347 - RNA, 438 nt, Artificial Sequence
  derived and/or modified sequence opt4 from anti-HIV_cap256-119-150980_VR-Chain
caggugcagcugguggagagcggcggcggcguggugcagcccggcaagagccugagacugagcugcgccgccagcggcuucauccugagcaacuacgccaugcacugggugagacaggcccccggcaagggccuggaguggguggccagcaucagcaacgacggcagcaagaaguaccacggcgacagcgugugggccagauucaucaucagcagagacaacagcaagaacacccuguuccugcagaugagcagccugagagccgaggacaccgcccuguacuucugcgugagagaccacagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32348 - RNA, 432 nt, Artificial Sequence
  derived and/or modified sequence opt4 from anti-HIV_cap256-119-148895_VR-Chain
caggugcagcugguggagagcggcggcggcguggugcagcccggcagaagccugagacugagcugcgccgccagcggcuucaccuucagaagcuacggcaugcacugggugagacaggcccccggcaagggccuggaguggguggccgugaucagcagcgacggcgacaucgaguacuacacccagagcgugaagggcagauucaccaucagcagagacaacagcaagaacacccuguaccugcagaugaacgcccugagacccgaggacaccgccauguacuacugcgccagagaccagagauacuacgagugcgaggagugggccagcgacuacuacgacuucggcagagagcagcccugccaggaccccagaggcguggugggcguguucgacauguggggccagggcaccauggugaccgugagcagc

SEQ ID NO: 32349 - RNA, 438 nt, Artificial Sequence
  derived and/or modified sequence opt4 from anti-HIV_cap256-119-148848_VR-Chain
cagaugcagcugguggagagcggcggcggcguggugcagcccggcagaagccugacccugagcugcgccgccagccaguucagcuucaccagcuacggcaugcacugggugagacaggcccccggcaagggccuggaguggguggccagcaucagcaacgacggcaccaagaaguaccacggcgagagcgugugggacagauucagcaucagcagagacaacagcaagaacacccuguuccugcagaugaacagccugagaguggaggacaccgcccuguacuucugcgugaaggaccagagagaggacgagugcgaggagugguggagcgacuacuacgacuucggcaaggagcugcccugcagaaaguggaagaccagaggcguggccggcauccuggacaacuggggccagggcaccaugcugaccgugagcagc

SEQ ID NO: 32350 - RNA, 432 nt, Artificial Sequence
  derived and/or modified sequence opt4 from anti-HIV_cap256-119-148743_VR-Chain
caggugcagcugguggagagcggcggcggcguggugcagcccggcagaagccugacccugagcugcgccgccagccaguucaacuucgccaacuacggcaugcacugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcaagaagcugcccugcagaaagagcagaggccuggccggcaucuuccacguguggggccacggcaccauggugaccgugagcagc

SEQ ID NO: 32351 - RNA, 432 nt, Artificial Sequence
  derived and/or modified sequence opt4 from anti-HIV_cap256-119-148595_VR-Chain
gaggugcagcugguggagagcggcggcggccuggugcagcccggcggcagccugagacugagcugcgccgccagcagauucaccuucgacaacuacggcaugcacugggugagacaggcccccggcaagggccuggaguggguggcccugcugaacuacgacggcagcaagaaguacuacguggacagcgugaagggcagauucaucaucuucagagacaacagcaagaacacccuguuccugcagaugaacagccugagacccgaggacaccgcccuguacuucugcgugaaggaccagagagaggacgccugcgaggagugguggagcgacuacuacgacuucggcaagaagcugcccugcagaaagagcagaggccuggccggcaucuuccacguguggggccacggcaccauggugaccgugagcagc

SEQ ID NO: 32352 - RNA, 432 nt, Artificial Sequence
  derived and/or modified sequence opt4 from anti-HIV_cap256-119-148490_VR-Chain
caggugcagcugguggagagcggcggcggcguggugcagcccggcagaagccugagacugagcugcguggccagcggcuucaccuucagcgacuacgccaugcacugggugagacaggcccccggcaagggccuggaguggguggccaccaucagcuucgacggcgccgacaaguaccacgccgacgacguguggggcagauucaccaucagcagagacaacagcaagaacacccuguaccugcagaugaacagccugagacccgaggacaccgcccuguacuacugcgccaaggaccugagagaggacgagugcgaggagagauggagcgacuacuacgacuucggcaagcagcugcccugcagaaagagcagaggcguggccggcguguucgacaacuggggccagggcaccauggugaccgugagcagc

SEQ ID NO: 32353 - RNA, 438 nt, Artificial Sequence
  derived and/or modified sequence opt4 from anti-HIV_cap256-119-148470_VR-Chain
caggugcagcugguggagagcggcggcggcguggugcagcccggcagaagccugagacugagcugcguggccagcggcuucaccuucagcagcuacggcauccacugggugagacaggcccccggcaagggccuggaguggguggccgugaucagcgacgacggcagcaagaaguaccacgaggagagcguguggggcagauucaccaucagcaaggacaacagcaagaacacccuguuccugcagaugaacagccugagaaucgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32354 - RNA, 432 nt, Artificial Sequence
  derived and/or modified sequence opt4 from anti-HIV_cap256-119-148107_VR-Chain
gaggugcagcugguggagagcggcggcggccuggugcagcccggcggcagccugagacugagcugcgccgccagcggcuucaccgugagcagcaacuacaugaccugggugagacaggcccccagaaagggccuggagugggugggcagcaucagcuacgacggcagcgacaaguaccacaccaacagccuguggggcagauucaucgugagcagagacaacagcaagaacacccuguaccugcagaugaacaaccugagacccgaggacaccgcccuguacuacugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32355 - RNA, 432 nt, Artificial Sequence
  derived and/or modified sequence opt4 from anti-HIV_cap256-119-147933_VR-Chain
gagcugcagcugguggagagcggcggcggccuggugcagcccggcuggagccugagacugagcugcgaggccagcggcuuccccuucagcgccuucuggaugaccugggugagacaggcccccggcaagggccugggcuggguggccuucaucagauacgacggcagcaacaaguacuacgccgacagcgugaagggcagauucaccaucagcagagacaacagcaugaccacccuguaccugcagaugaacagccugagagccgaggacgccgccguguacuacugcgccaaggaccugagagaggacgagugcgaggagugguggagcgacuacuacgacuucggcaagagacugcccugcagaaagagcagaggcguggccggcguguucgacaaguggggccagggcaccauggugaccgugagcagc

SEQ ID NO: 32356 - RNA, 432 nt, Artificial Sequence
  derived and/or modified sequence opt4 from anti-HIV_cap256-119-147434_VR-Chain
caggugcagcugguggagagcggcggcggcguggugcaggccggcagaagccugagacugagcugcgccgccagccaguucaccuucggcagauacggcaugcacugggugagacaggcccccggcaagggccuggagugggugggcagcaucagcuacgacggcagcgacaaguaccacaccaacagcguguggggcagauucaucgugagcagagacaacagcaagaacacccuguaccugcagaugaacagccugagacccgaggacaccgccauguacuacugcgccagagaccagagauacuacgagugcgaggagugggccagcgacuacuacgacuucggcagagagcagcccugccaggaccccagaggcguggugggcguguucgacauguggggccagggcaccauggugaccgugagcagc

SEQ ID NO: 32357 - RNA, 435 nt, Artificial Sequence
  derived and/or modified sequence opt4 from anti-HIV_cap256-119-146106_VR-Chain
caggugcagcugguggagagcggcggcggcguggugcagcccggcagaagccugagacugagcugcgccgccagcggcuucaccuucagcagcagcggcaugcacugggugagacaggcccccggcaagggccugcaguggguggccgugaucagcuacgacggcggcaacaaguacuacgccgacagcgugaagggcagauucaccaucagcagagacaacagcaagaacaaccuguaccugcagaugaacagccugagacccgaggacaccgcccuguacuacugcgccagagaccugagagagauggagugcgaggaguggaagcuguacaacuacuacgacuucagaaccagaggccccugcguggaccccagaggcguggugggcagcuucgacguguggggccagggcaccguggugaccgugagcagc

SEQ ID NO: 32358 - RNA, 438 nt, Artificial Sequence
  derived and/or modified sequence opt4 from anti-HIV_cap256-119-145604_VR-Chain
gacgugcagcuggccgagagcggcggcggccuggugcagcccggcggcagccugagacugagcugcguggccagcggcuucaccuucagcagcuucgagaugcacugggugagacaggcccccggcaagggccuggaguggguggccagcaucagcaacgacggcaccaagagauaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32359 - RNA, 438 nt, Artificial Sequence
  derived and/or modified sequence opt4 from anti-HIV_cap256-119-143998_VR-Chain
caggugcagcugguggagagcggcggcggcguggugcagcccggcagaagccugagacugagcugcgccgccagcggcuucaccuucagaaacuacggcaugcacugggugagacaggcccccggcaagggccuggaguggguggccagcaucagcaacgacggcagcaagaaguaccacggcgacagcgugugggccagauucaucaucagcagagacaacagcaagaacacccuguuccugcagaugagcagccugagagccgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32360 - RNA, 438 nt, Artificial Sequence
  derived and/or modified sequence opt4 from anti-HIV_cap256-119-143441_VR-Chain
gaggugcaccugguggagagcggcggcggccuggcccagcccggcagaagccugagacugagcugcgccgccagccaguucaacuucgccagcuacggcaugcacugggugagacaggcccccggcaagggccuggaguggguggccagcaucagcaacgacggcaccaagagauaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32361 - RNA, 432 nt, Artificial Sequence
  derived and/or modified sequence opt4 from anti-HIV_cap256-119-141307_VR-Chain
caggugcaccugguggagagcggcggcggcguggugcagcccggcagaagccugagacugagcugcgccgccagccaguucaccuucaacagauacggccugcacugggugagacaggcccccggcaagggccuggaguggguggccggcaucagcuacgacggcagagacaaguaccacgcccacuucguguggggcagauucaucaucagcagagacaacagcaagaacacccuguaccugcagaugaacagccugagagccgaggacaccgcccuguacuacugcgugagagaccugagagagagcgagugcgagcugugggagagcgacuacuacgacuucggcaagagacugcccugcgugaagcccagaggcguggccggcaccuucgaccuguggggccagggcaccauggugaccgugagcagc

SEQ ID NO: 32362 - RNA, 432 nt, Artificial Sequence
  derived and/or modified sequence opt4 from anti-HIV_cap256-119-140896_VR-Chain
gaggugaagcugguggagagcggcggcggccuggugcagcccggcggcagccugaagcugagcugcgccgccagcggcuucaccuucagcuacuacgccaugcacugggugagacaggcccccggcaagggccuggaguggguggccgugaucagcuacgacggcagcgacaaguacuacgccgacagcgugaagggcagauucaccaucagcagagacaacagcaagaacacccugcaccugcagaugaacagccugagacccgaggacaccgcccuguacuucugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32363 - RNA, 432 nt, Artificial Sequence
  derived and/or modified sequence opt4 from anti-HIV_cap256-119-140090_VR-Chain
gaggugcagcugguggagagcggcggcggccuggugcagcccggcggcagccugagacugagcugcgccgccagcggcuucgccuucagcagcuacuggaugaccugggugagacaggcccccggcaagggccuggaguggguggccgugaucagcuacgacggcagcaacaaguacuacgccgacagcgugagaggcagauucaccaucagcagagacagcagcaagaacacccuguaccuggagaugaacagccugagacccgaggacaccgcccuguacuacugcgccaaggacaugagaggcuacgagugcgaggaguggaccagcgacuacuacgacuucggcagaccccagcccugcaucgacagcagaggcguggugggcaccuucgacguguggggccagggcaccauggugaccgugagcagc

SEQ ID NO: 32364 - RNA, 438 nt, Artificial Sequence
  derived and/or modified sequence opt4 from anti-HIV_cap256-119-140037_VR-Chain
caggugcagcugguggagagcggcggcggccuggugcagcccggcagaagccugagacugagcugcgccgccagcggcuucaccuucgacgacuacgugaugcacugggugagacaggcccccggcaagggccuggaguggguggccagcaucagcaacgacggcaccaagaaguaccacgaggagagcguguggggcagauucaccaucagcaaggacaacagcaagagcacccuguuccugcagaugaacagccugagaaucgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32365 - RNA, 432 nt, Artificial Sequence
  derived and/or modified sequence opt4 from anti-HIV_cap256-119-139135_VR-Chain
gaggugcagcugguggagagcggcggcggcguggugagacccggcggcagcgugagacugagcugcguggccagcggcuucagcuucagaagcuacggcaugcacugggugagacaggcccccggcaagggccuggaguggguggccagcaucagcuacgacggcagagacuucuaccacgccagaagcguguggggcagauucaccaucagcagagacaacagcaagaacacccugcaccugcagaugaacagccugagacccgaggacaccgcccuguacuucugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32366 - RNA, 438 nt, Artificial Sequence
  derived and/or modified sequence opt4 from anti-HIV_cap256-119-137881_VR-Chain
caggugcagcugguggagagcggcggcggccuggugaagcccggcagaagccugacccugagcugcgccgccagccaguucaccuucagcaacuacggcaugcacugggugagacaggcccccggcaagggccuggaguggguggccagcaucagcaacgacggcaacaagaaguaccacggcgacagcgugugggccagauucaccaucagcagagacaacagcaagaacacccuguuccugcagaugagcagccugagaaccgaggacaccgcccuguacuucugcgugagagacagaagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32367 - RNA, 432 nt, Artificial Sequence
  derived and/or modified sequence opt4 from anti-HIV_cap256-119-137643_VR-Chain
gaggugcagcugguggagagcggcggcgaccuggugcagcccggcggcagccugagacugagcugcgccgccagcggcuucagcuucagcagcuacggcaugcacugggugagacaggcccccgacaagggccuggagugggugaccgugaucagcuacgacggcagcaacaagcacuacgccgacagcgugaagggcagauucaccaucagcagagacaacagcaagaacacccuguaccuggagaugaacacccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugagcgugagcagc

SEQ ID NO: 32368 - RNA, 438 nt, Artificial Sequence
  derived and/or modified sequence opt4 from anti-HIV_cap256-119-137170_VR-Chain
caggugcagcugguggagagcggcggcggcguggugcagcccggcagaagccugagacugagcugcgccgccagcgaguucaccuucagcagauacagcaugcacugggugagacaggcccccggcaagggccuggaguggguggccgugaucagcagcgacggcagcaaccaguuccacgccgacagcguguggggcagauucaccaucagcaaggacaacagcaagaacacccuguuccugcagaugaacagccugagaaucgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32369 - RNA, 432 nt, Artificial Sequence
  derived and/or modified sequence opt4 from anti-HIV_cap256-119-136616_VR-Chain
caggugcagcugguggagagcggcggcggcguggugcagcccggcagaagccugagacugagcugcgccgccagcggcuucaccuucagcagaaacgccaucaacugggugagacaggcccccggcagaggccuggaguggguggccgugaucagcgacgacggcagccugaaguacuacgccgacagcgugaagggcagauucaccaucagcagagacaacagcaagaacacccuguaccugcagaugaacaaccugagacccgaggacaccgcccuguacuacugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32370 - RNA, 432 nt, Artificial Sequence
  derived and/or modified sequence opt4 from anti-HIV_cap256-119-136206_VR-Chain
caggugcagcugguggagagcggcggcggcguggugcagcccggcagaagccugagacugagcugcgccgccagccaguucaccuucggcagauacggcaugcacugggugagacaggcccccggcaagggccuggaguggguggccgccaucagcuucgccggcaccaagaaguacuacggcgacagcgccagaggcagauucaccaucagcagagacaacagcaagaacaugcuguuccugcagaugaacagccugagagccgaggacaccgcccuguacuacugcgccagagaccugagagacuacgagugcgaggagugggaggccuacuacuacgacuucggcagagugggccccugcaccgaccccagaggcguggugggcauccuggacguguggggccagggcacccuggugaccgugagcagc

SEQ ID NO: 32371 - RNA, 438 nt, Artificial Sequence
  derived and/or modified sequence opt4 from anti-HIV_cap256-119-135565_VR-Chain
caggugcaccugguggagagcggcggcggcguggugcagcccggcaagagccugagacugagcugcgccgccagccaguucaccuucgacagauacggcaugcacugggugagacaggcccccggcaagggccuggaguggguggccagcaucagcaacgacggcaccgacaaguaccacgccgacaacguguggggcagauucaccaucagcagagacaacagcaagaacacccuguaccuggagaugaacagccugagaggcgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32372 - RNA, 432 nt, Artificial Sequence
  derived and/or modified sequence opt4 from anti-HIV_cap256-119-135025_VR-Chain
gaggugcagcugguggagagcggcggcggccuggugcagcccggcggcagccugagacugagcugcgaggccagcggcuucaccuucaacaccuacgagaugaacugggugagacagccccccggcagaggccuggaguggguggccggcaucagcuucgccgccaccaagaccuacuacggcggcagcgugaagggcagauucaccgugagcagagacaucagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32373 - RNA, 432 nt, Artificial Sequence
  derived and/or modified sequence opt4 from anti-HIV_cap256-119-133983_VR-Chain
cagaugcagcugguggagagcggcggcggcguggugcagcccggcagaagccugacccugagcugcgccgccagccaguucaacuucgccaacuacggcaugcacugggugagacaggcccccggcaagggccuggaguggguggccagcaucagcaacgacggcaccaagaaguaccacgaggagagcguguggggcagauucaccaucagcaaggacaacagcaagaacacccuguuccugcagaugaacagccugagacccgaggacaccgcccuguacuacugcgccaaggaccugagagaggacgagugcgaggagagauggagcgacuacuacgacuucggcaagcagcugcccugcagaaagagcagaggcguggccggcguguucgacaacuggggccagggcaccauggugaccgugagcagc

SEQ ID NO: 32374 - RNA, 438 nt, Artificial Sequence
  derived and/or modified sequence opt4 from anti-HIV_cap256-119-133917_VR-Chain
cagaugcagcugguggagagcggcggcggcguggugcagcccggcagaagccugacccugagcugcgccgccagccaguucaccuucagcaacuacggcaugcacugggugagacaggcccccggcaagggccuggaguggguggccagcaucagcaacgacggcagcaagaaguaccacggcgacagcgugugggccagauucaccaucagcagagacaacagcaagaacacccuguuccugcagaugagcagccugagaguggaggacaccgcccuguacuucugcgugagagaccagagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32375 - RNA, 432 nt, Artificial Sequence
  derived and/or modified sequence opt4 from anti-HIV_cap256-119-132663_VR-Chain
caggcccagcugguggagagcggcggcggcguggugcagcccggcagaagccugagaaucagcugcgccgugagccaguucaccuucagcagauacggcaugcacugggugagacaggcccccggcaagggccuggaguggguggccagcaucagcuucgacggcagagacaaguaccacagcccccugguguggggcagacugaccaucagcagagacaacagcaagaacacccuguuccuggagaugaacagccugagagccgaggacaccgccguguacuacugcgccagagaccugagagagagcgagugcgaggaguggcagagcgacuacuacgccuucuacaagaagcugcccugcgugaagcccagaggcguggccggcagccuggacaucuggggccagggcaccguggugaccgugagcagc

SEQ ID NO: 32376 - RNA, 438 nt, Artificial Sequence
  derived and/or modified sequence opt4 from anti-HIV_cap256-119-132113_VR-Chain
caggugcagcugguggagagcggcggcggccuggugaagcccggcggcagccugagacugagcugcgccgccagccaguucaacuucgccaacuacggcaugcacugggugagacaggcccccggcaagggccuggaguggguggccagcaucagcaacgacggcaccaagaaguaccacgaggagagcguguggggcagauucaccaucagcaaggacaacagcaagagcacccuguuccugcagaugaacagccugagaaucgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32377 - RNA, 432 nt, Artificial Sequence
  derived and/or modified sequence opt4 from anti-HIV_cap256-119-131839_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccagagaccagagauacuacgagugcgaggagugggccagcgacuacuacgacuucggcagagagcagcccugccaggaccccagaggcguggugggcguguucgacauguggggccagggcaccauggugaccgugagcagc

SEQ ID NO: 32378 - RNA, 435 nt, Artificial Sequence
  derived and/or modified sequence opt4 from anti-HIV_cap256-119-130626_VR-Chain
gaggugcagcugguggagagcggcggcggccugauccaccccggcggcugccugagacugagcugcgccgugagcggcuucaccuucagcgacuaccccaugcacugggugagacagagccccggcaagggccuggaguggguggccgugaucagcuacgacggcaucaacuacuacuacgccgacagcgugaagggcagauucaccaucagcagagacaacagcaagaacaaccuguuccugcagaugaacagccugagacuggaggacaccgcccuguacuacugcgccagagaccugagagagcuggacugcgaggaguggacccuguacaacuacuacgacuucggcagcagaggccccugcguggaccccagaggcgugggcggcagcuucgacguguggggccagggcaccauggugaccgugagcagc

SEQ ID NO: 32379 - RNA, 438 nt, Artificial Sequence
  derived and/or modified sequence opt4 from anti-HIV_cap256-119-130191_VR-Chain
gaggugcagcugguggagagcggcggcggccugauccagcccggcagaagccugagacugagcugcgccgccagcggcuucaccgugagcagcaacuucaugaccugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32380 - RNA, 438 nt, Artificial Sequence
  derived and/or modified sequence opt4 from anti-HIV_cap256-119-129798_VR-Chain
caggugcagcugguggagagcggcggcggcguggugcagcccggcaagagccugagacugagcugcgccgccagcggcuucaucuucagcagcuacuucaugcacugggugagacaggcccccggcaagggccuggaguggguggccguggugaccgacgacggcagcaagaaguacuacgccgacagcgugaagggcagauucaccaucagcagagacuacagcaagaacacccuguuccugcagaugaacagacugagaguggaggacaccgcccuguacuucugcgugaaggaccagagagaggacgagugcgaggagugguggagcgacuacuacgacuucggcagagagcugcccugcagaaaguucagaggccugggccuggccggcaucuucgacauguggggccacggcaccauggugaccgugagcagc

SEQ ID NO: 32381 - RNA, 432 nt, Artificial Sequence
  derived and/or modified sequence opt4 from anti-HIV_cap256-119-128745_VR-Chain
caggugcagcugguggagagcggcggcggcguggugcagcccggcagaagccugagacugagcugcgccgccagcggcuucaccuucagcaacuacgccaugcacugggugagacaggcccccggcaagggccuggaguggguggccagcaucagcuucgccggcaccaagacccacuacggcaacagcgugaagggcagauucagcaucagcagagacaacagcaucaacaccguguaccugcagaugaacagccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggagccagggcaccauggugaccgugagcagc

SEQ ID NO: 32382 - RNA, 438 nt, Artificial Sequence
  derived and/or modified sequence opt4 from anti-HIV_cap256-119-128593_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccagcaucagcuacgacggcagagacuucuaccacgccagaagcguguggggcagauucaccaucagcagagacaacagcaagaacacccugcaccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacaucuggggccacggcaccauggugaccgugagcagc

SEQ ID NO: 32383 - RNA, 438 nt, Artificial Sequence
  derived and/or modified sequence opt4 from anti-HIV_cap256-119-128152_VR-Chain
caggugcagcugguggagagcggcggcggcguggugcagcccggcagaagccugagacugagcugcgccgugagcggcuucaccuucaccagcuaccccaugcacugggugagacaggcccccggcaagggccuggaguggguggccagcgugagcaacgacggcaccaagaaguaccacggcgacagcgugugggacagauucaccaucagcagagacaacagcaagaacacccuguuccugcagaugagcagccugagagccgaggacaccgccguguacuucugcgugagagacgagagagaggacgagugcgaggagugguggagcgacuacuacgacuucggcagagagcugcccugcagaaaguucagaggccugggccuggccggcaucuucgacaucuggggccacggcacccuggugaccgugagcagc

SEQ ID NO: 32384 - RNA, 438 nt, Artificial Sequence
  derived and/or modified sequence opt4 from anti-HIV_cap256-119-127693_VR-Chain
gaggugcagcugcuggagagcggcggcggccuggugcagcccggcggcagccugagacugagcugcgccgccagcggcuucaccuucagcagcuacgccauggccugggugagacaggcccccggcaagggccuggaguggguggccagcaucagcaacgacggcagcaagaaguaccacggcgacagcgugugggccagauucaucaucagcagagacaacagcaagaacacccuguuccugcagaugagcagccugagaguggaggacaccgcccuguacuucugcgugagagaccacagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32385 - RNA, 432 nt, Artificial Sequence
  derived and/or modified sequence opt4 from anti-HIV_cap256-119-126684_VR-Chain
caggugcagcugguggagagcggcggcggcgccgugagacccggcagaagccugagacugagcugcgccaccagcggcuucaccuucagcaacuacgccaugcacugggugagacaggcccccggcaagggccuggagugggugaccggcaucagcuucgccggcaccaagaccuacuacggcgacagcgugagaggcagauucaccgugagcagagacaucagcaagaacacccuguuccugcagaugaacagccugagacccgacgacaccgccauguacuacugcgccagagaccagagauacuacgagugcgaggagugggccagcgacuacuacgacuucggcagagagcagcccugccuggaccccagaggcguggugggcaucuucgaccuguggggccagggcaccauggugaccgugagcagc

SEQ ID NO: 32386 - RNA, 438 nt, Artificial Sequence
  derived and/or modified sequence opt4 from anti-HIV_cap256-119-126056_VR-Chain
gaggugcagcugguggagagcggcggcggccuggugcagcccggcggcagccugagacugagcugcgccgacagcggcuucaccuucagcagcuacuggaugagcugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32387 - RNA, 432 nt, Artificial Sequence
  derived and/or modified sequence opt4 from anti-HIV_cap256-119-125765_VR-Chain
caggugcagcuggugcagagcggcggcggcguggugcagcccggcagaagccugagacugagcugcgccgccagcggcuucaccuucagcagcuacgugaugcacugggugagacaggcccccggcaagggccuggagggcguggccgugaucagcuucgacggcaacaacgaguacuacgccgacagcgugaagggcagauucaccaucagcagagacaacagcaagaacaccguguaccugcagaugaacagccugagaguggaggacaccgcccuguacuacugcgccaaggacaugagagaguacgagugcgaggaguggaccagcgacuacuacgacuucggcagaccccagcccugcaucgacagcagaggcguggugggcauccuggacaucuggggccagggcaucauggugaccgugagcagc

SEQ ID NO: 32388 - RNA, 438 nt, Artificial Sequence
  derived and/or modified sequence opt4 from anti-HIV_cap256-119-125106_VR-Chain
caggugcagcugguggagagcggcggcggcguggugcagcccggcagaagccugagacugagcugcgccgccagcggcuucaucuucagaagcuacggcaugcacugggugagacaggcccccggcaagggccuggaguggguggccagcaucagcaacgacggcaccaagagauaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32389 - RNA, 435 nt, Artificial Sequence
  derived and/or modified sequence opt4 from anti-HIV_cap256-119-124026_VR-Chain
caggugcagcugguggagagcggcggcggcguggugcagagcggcagaagccugagacugaccugcagcggcagcgccuucagauucagcagcuacaccgugcacugggugagacaggcccccggcaagggccuggaguggcuggcccugaucagcuacgacggccagaagaagcacuucgccgacagcgugaagggcagauucaccaucagcagagacaacagcaagaacaaccuguuccugcagaugaacagccugagacuggaggacaccgcccuguacuacugcgccagagaccugagagagcuggacugcgaggaguggacccuguacaacuacuacgacuucggcagcagaggccccugcguggaccccagaggcgugggcggcagcuucgacguguggggccagggcaccauggugaccgugagcagc

SEQ ID NO: 32390 - RNA, 432 nt, Artificial Sequence
  derived and/or modified sequence opt4 from anti-HIV_cap256-119-121783_VR-Chain
cugggcagacugguggccagcggcggcggcguggugccccccggcggcagccugacccugagcugcgugaccagccaguucaccuucagcggcugcggccugcacugggugagacaggcccccggcaagggccuggaguggguggccagcaucagcuucgccggcaccaagaagcacuacggcagcagcgugagaggcagauucagcaucagcagagacaacagcaagaacacccuguaccugcagaugaacagccugagaaccgaggacaccgcccuguacuucugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32391 - RNA, 432 nt, Artificial Sequence
  derived and/or modified sequence opt4 from anti-HIV_cap256-119-121208_VR-Chain
cugggcagacugguggccagcggcggcggcguggugccccccggcaagagccugacccugagcugcguggccagccaguucaccuucagcggcugcggccugcacugggugagacaggcccccggcaagggccuggaguggguggccagcaucagcuucgccggcaccaagaagcacuacggcaacuucgugagaggcagauucaccaucagcagagacaacagcaagaacacccuguaccugcagaugaacagccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32392 - RNA, 432 nt, Artificial Sequence
  derived and/or modified sequence opt4 from anti-HIV_cap256-119-120945_VR-Chain
caggugcagcugguggagagcggcggcggcguggugcagcccggcggcagccugagacugagcugcguggccagcggcuucaccuucagcaacuacggcaugcacugggugagacaggcccccggcaagggccuggccuggguggccuucaucagauacgacggcagcaacaaguacuacguggacagcguguggggcagauucaccaucagcagagacaacagcaagaacacccugcaccugcagaugaacagccugagacccgaggacaccgcccuguacuucugcgccagagaccugagagagagcgagugcgaggagugggagagcuacuacuacgacuucggcaacaagggccccugcgugaagcccagaggcguggugggcgugcuggacaucuggggccagggcacccuggugaccgugagcagc

SEQ ID NO: 32393 - RNA, 432 nt, Artificial Sequence
  derived and/or modified sequence opt4 from anti-HIV_cap256-119-118229_VR-Chain
caggugcaggugguggagagcggcggcggcguggugcagcccggcagaagccugagacugagcugcgccgccagcggcuucaccuucagcaacuacgccauccacugggugagacaggcccccggcaagggccuggaguggguggcccugaucagcuacgacggcuacaacaaguacuacgccgacagcgugagaggcagauucaccaucagcagagacaacagcaacaacaccguguaccugcagaugaacagccugaagcccgaggacaccgccguguacuacugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32394 - RNA, 432 nt, Artificial Sequence
  derived and/or modified sequence opt4 from anti-HIV_cap256-119-118025_VR-Chain
gaggugcagcugguggagagcggcggcggcguggugcagcccggcaagagccugagacugagcugcaccgccagccaguucaccuucagcaacuucggcaugcacugggugagacaggcccccggcaagggccuggaguggguggccagcaucagcuucgugggcaucaagacccacuacgccaacagcgugagaggcagauucaccaucagcagagaccagagcaagaacacccuguaccugcagaugaacagcgugagaaucgaggacaccgccagauacuucugcgccagagacaugagagaguacgagugcgagcugugggccagcgacuacuacgacuucggcaagccccagcccugcgaggaccccagaggcguggugggcaccuucgacauguggggccugggcacccuggugaccgugagcagc

SEQ ID NO: 32395 - RNA, 432 nt, Artificial Sequence
  derived and/or modified sequence opt4 from anti-HIV_cap256-119-117418_VR-Chain
caggugcagcugguggagagcggcggcggcguggugcagcccggcagaagccugagacugagcugcgccgccagcggcuucaacuucagaaacuacgacaucaacugggugagacaggugcccggcaagggccuggaguggguggccgccaucagcuucgacggcgccgacaaguaccacgccgacaacguguggggcagacugagcaucagcagagacaacagcaagagcacccuguaccugcagaugaacagccugagacccgaggacaccgccguguacuucugcgccaaggaccugagagaggacgagugcgaggagagauggagcgacuacuacgacuucggcaagcagcugcccugcagaaagagcagaggcguggccggcaucuucgacaacuggggccagggcaccauggugaccgugagcgcc

SEQ ID NO: 32396 - RNA, 432 nt, Artificial Sequence
  derived and/or modified sequence opt4 from anti-HIV_cap256-119-117250_VR-Chain
caggugagacugguggagagcggcggcggcguggugcagcccggcggcagccugagacugagcugcgccgccagccaguucaccuucagcgccuacggcaugcacugggugagacaggcccccggcaagggccuggaguggguggccagcaucagcuucgacggcaccgacaaguuccacgccgacaagguguggggcagacuggugaucagcagagacaacagcaagaacacccuguaccugcagaugaacagccugagacccgaggacaccgccguguacuacugcgccaaggaccugagagaggacgagugcgaggagagauggagcgacuacuacgacuucggcaagcagcugcccugcagaaagagcagaggcguggccggcguguucgacaacuggggccagggcaccauggugaccgugagcagc

SEQ ID NO: 32397 - RNA, 432 nt, Artificial Sequence
  derived and/or modified sequence opt4 from anti-HIV_cap256-119-117230_VR-Chain
caggugcagcugguggagagcggcggcggcggcgugcagcccggcagaagccugagacugagcugcgccgccagcggcuucacccugagcagcuacggcaugcacugggugagacaggcccccggcaagggccuggaguggguggccagcaucagcuucgacggcagagacuacuaccacagcccccacguguggggcagacugaccaucagcagagacaacagcaagaacacccuguaccugcagaugaacagccugagagccgaggacaccgcccuguacuacugcgccagagaccugagagagagcgagugcgaggagugggagagcgacuacuacgacuucggcaagaagggccccugcgugaagcccagaggcguggccggcagccuggacauguggggccagggcaccauggugaucgugagcagc

SEQ ID NO: 32398 - RNA, 432 nt, Artificial Sequence
  derived and/or modified sequence opt4 from anti-HIV_cap256-119-116999_VR-Chain
caggugcagcugguggagagcggcggcggcguggugcagcccggcaccagccugagaaucagcugcgccgccagccaguucaccuucagcagauacggcaugcacugggugagacaggcccccggcaagggccuggaguggguggccagcaucagcuacgacggcagagacuacuaccacgccggcagaguguggggcagauucaccaucagcagagacaacagcaagaacacccuguaccugcagaugaacagccugagacccgaggacaccgcccuguacuucugcgugagagacagcagagagagcgagugcgaggagugggagagcgacuacuacgacuucggcaagaagcugcccugcgugaagcccagaggcguggugggcgugcuggaccuguggggccagggcacccuggugaccgugagcagc

SEQ ID NO: 32399 - RNA, 432 nt, Artificial Sequence
  derived and/or modified sequence opt4 from anti-HIV_cap256-119-116558_VR-Chain
caggugcagcugguggagagcggcggcggcguggugcagcccggcagaagccugagacugagcugcgccgccagcggcuucaccuucaacagauacagccugcacugggugagacaggcccccggcaagggccuggaguggguggccuucaccagcuacgacggcagcaacaaguacuaccccgacagcgugaagggcagauucaccaucagcagagacagcagcaagaacacccuguaccuggagaugaacagccugagacccgaggacaccgcccuguacuacugcgccaaggacaugagaggcuacgagugcgaggaguggaccagcgacuacuacgacuucggcagaccccagcccugcaucgacagcagaggcguggugggcaccuucgacguguggggccagggcaccauggugaccgugagcagc

SEQ ID NO: 32400 - RNA, 432 nt, Artificial Sequence
  derived and/or modified sequence opt4 from anti-HIV_cap256-119-116484_VR-Chain
gacgugcagcugcuggagagcggcggcgaccuggugcagcccggcggcagccugagacugagcugcgccgccagcggcuucaccuucaccaaguacgagaugaccugggugagacaggcccccggcaagggccuggaguggguggccagcaucagcuacgacggcagcgacaaguaccacaccagcagccuguggggcagauucaucgugagcagagacaacagcaagaacacccuguaccugcagaugaacagccugagacccgaggacaccgcccuguacuacugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32401 - RNA, 438 nt, Artificial Sequence
  derived and/or modified sequence opt4 from anti-HIV_cap256-119-114844_VR-Chain
gaggugcagcugguggagagcggcggcgaccuggugcagcccggcagaagccugagacugagcugcgccgccagcggcuucaccuucagcagcuacuggaugagcugggugagacaggcccccggcaagggccuggaguggguggccagcaucagcaacgacggcaccaagaaguaccacgaggagagcguguggggcagauucaccaucagcaaggacaacagcaagagcacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32402 - RNA, 438 nt, Artificial Sequence
  derived and/or modified sequence opt4 from anti-HIV_cap256-119-114141_VR-Chain
ggcggcagaagcggcggcggcggcgugggcaccacccccagaagaggcccccugagacugagcugcgccgccagcggcuucacccuggacgacuacgccaugcacugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacguguucugggagagagcccccugcagaaccgugcccggcagaggccccggcugguacuucgacauggugggcagaagaaccauggugaccgugagcagc

SEQ ID NO: 32403 - RNA, 432 nt, Artificial Sequence
  derived and/or modified sequence opt4 from anti-HIV_cap256-119-111917_VR-Chain
gaggugcaccugguggagagcggcggcggccuggugcagcccggcggcagccugagacugagcugcgccgccagcggcuucaccuucagcagcuacggcaugcacugggugagacaggcccccggcaagggccuggaguggguggccaccaucagcuucgacggcgccgacaaguaccacgccgacgacguguggggcagauucagcaucagcagagacaacagcaagaacacccuguaccugcagaugaacaaccugagacccgaggacaccgcccuguacuacugcgccaaggaccugagagaggacgagugcgaggagagauggagcgacuacuacgacuucggcaagcagcugcccugcagaaagagcagaggcguggccggcguguucgacaacuggggccagggcaccauggugaccgugagcagc

SEQ ID NO: 32404 - RNA, 432 nt, Artificial Sequence
  derived and/or modified sequence opt4 from anti-HIV_cap256-119-111862_VR-Chain
caggugcagcugguggagagcggcggcggcguggugcagcccggcggcagccugagacugagcugcgccgccagcggcuucaccuacagcgacuacggcaugcacugggugagacaggcccccggcaagggccuggaguggguggccagcaucagcuucgccggcaccaagcagcacuacggcaacagcgugaagggcagauucaccaucagcagagacaacagcaagaacaccguguaccugcagaugaacagccugagaguggaggacaccgcccuguacuacugcgccaaggacaugagagaguacgagugcgaggaguggaccagcgacuacuacgacuucggcagaccccagcccugcaucgacagcagaggcguggugggcauccuggacaucuggggccagggcaucauggugaccgugagcagc

SEQ ID NO: 32405 - RNA, 432 nt, Artificial Sequence
  derived and/or modified sequence opt4 from anti-HIV_cap256-119-110064_VR-Chain
cugggcagacugguggccagcggcggcggcguggugccccccggcagaagccugagacugagcugcguggccagccaguucaccuucagcggcugcggccugcacugggugagacaggcccccggcaagggccuggaguggguggccagcaucagcuucgccggcaccaagcagcacuacggcaacagcgugaagggcagauucaccaucagcagagacaacagcaagaacaccguguaccugcagaugaacagccugagaguggaggacaccgcccuguacuacugcgccaaggacaugagagaguacgagugcgaggaguggaccagcgacuacuacgacuucggcagaccccagcccugcaucgacagcagaggcguggugggcauccuggacaucuggggccagggcaccauggugaccgugagcuuc

SEQ ID NO: 32406 - RNA, 432 nt, Artificial Sequence
  derived and/or modified sequence opt4 from anti-HIV_cap256-119-109192_VR-Chain
caggugcagcugguggagagcggcggcggcguggugcagcccggcagaagccugagacugagcugcgccgccagcggcuucaccuucagcaacuacgccaugcacugggugagacaggcccccggcaagggccuggaguggguggccgugaucgccuacgacggcgacaacaaguacuacgccgacagcgugaagggcagauucaccaucagcagagacaacagcaagaacacccuguaccugcagaugaacagccugagagccgaggacaccgcccuguacuacugcgccaaggaccugagagaggacgagugcgaggagugguggagcgacuacuacgaccugggcaagcagcugcccugcagaaagagcagaggcguggccggcgugcuggacaaguggggccugggcaccauggugaccgugagcagc

SEQ ID NO: 32407 - RNA, 435 nt, Artificial Sequence
  derived and/or modified sequence opt4 from anti-HIV_cap256-119-108793_VR-Chain
caguuccagcugguggagagcggcggcggcguggugcagcccggcagaagccugagacugagcugcgccgccagcggcuucaccuucagcagcuaccccaugcacugggugagacaggcccccggcaagggccuggaguggguggcccugaucagcuacgacggcaccgacaaguacuacgccgacagcgugaagggcagauucaccaucagcagagacaacagcaagaacacccuguaccugcagaugaacagccugagaguggaggacaccgccguguaccacugcgccaaggaccugggcggcagcaagagcgacgagugggccaccgacuacuacuacgacuggagcaaggccuaccccgugcacgaccccagagccguggugggcguguucgacaucuggggccagggcacccuggugaccgugagcagc

SEQ ID NO: 32408 - RNA, 432 nt, Artificial Sequence
  derived and/or modified sequence opt4 from anti-HIV_cap256-119-108127_VR-Chain
caggugcagcugguggagagcggcggcggcguggugcagcccggcagaagccugagaaucagcugcgccgccagccaguucaccuucaacagauacggcaugcacugggugagacaggcccccggcaagggccuggaguggguggccagcaucagcuacgacggcagcgacaaguaccacgccggccugguguggggcagauucaucaucagcagagacaacagcaagaacacccuguaccugcagaugaacagccugagagccgaggacaccgcccuguacuacugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32409 - RNA, 438 nt, Artificial Sequence
  derived and/or modified sequence opt4 from anti-HIV_cap256-119-107758_VR-Chain
gaggugcagcugguggagagcggcggcggccuggugaagcccggcggcagccugagacugagcugcgccgccagcggcuucaccuucagcaacgccuggaugagcugggugagacaggcccccggcaagggccuggaguggguggccagcaucagcaacgacggcaccaagaaguaccacgaggagagcguguggggcagauucaccaucagcaaggacaacagcaagaacacccuguuccugcagaugaacagccugagaaucgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32410 - RNA, 432 nt, Artificial Sequence
  derived and/or modified sequence opt4 from anti-HIV_cap256-119-107209_VR-Chain
gaggugcagcugguggagagcggcggcggccuggugcagcccggcagaagccugagacugagcugcaccgccagcggcuucaccuucggcgacuacggcaugcacugggugagacaggcccccggcaagggccuggaguggguggccgccaucagcuucgacggcgccgacaaguaccacgccgacaacguguggggcagacugagcaucagcagagacaacagcaagagcacccuguaccugcagaugaacagccugagacccgaggacaccgccguguacuucugcgccaaggaccugagagaggacgagugcgaggagagauggagcgacuacuacgacuucggcaagcagcugcccugcagaaagagcagaggcguggccggcaucuucgacaacuggggccagggcaccauggugaccgugagcgcc

SEQ ID NO: 32411 - RNA, 432 nt, Artificial Sequence
  derived and/or modified sequence opt4 from anti-HIV_cap256-119-107184_VR-Chain
caggcccagcugguggagagcggcggcggcguggugcagcccggcagaagccugggccugagcugcgccgccagcaaguucagccugagcagcuacggcaugcacugggugagacaggcccccggcagaggccuggaguggguggccggcaucagcuucgccggcaccaagaaguacuacgccgacagcgugagaggcagauucagcgugagcaccgacaucagcaagaacacccuguaccugcagaugaacagccugagacccgccgacaccgcccuguacuucugcgccagagaccugagauacuacgagugcgaggagugggccagcgacuacuacgacuucggcaaggagcagcccugccuggaccccagaggcguggugggcaucuucgaccuguggggccagggcaccauggugaccgugagcagc

SEQ ID NO: 32412 - RNA, 438 nt, Artificial Sequence
  derived and/or modified sequence opt4 from anti-HIV_cap256-119-106827_VR-Chain
gccgugcagcugguggagagcggcggcggccuggugcagcccggcggcagccugagacugagcugcagcgugagccaguucaccuucggcagauacggcauguacugggugagacaggcccccggcaagggccuggaguggguggccgugaucagcuacgacggcggcaacagauacuacgccgacagcgugaagaacagauucagcaucagcagagacaacagcaagaacacccuguuccugcagaugagcagccugagagccgaggacaccgcccuguacuucugcgugagagaccacagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32413 - RNA, 432 nt, Artificial Sequence
  derived and/or modified sequence opt4 from anti-HIV_cap256-119-106511_VR-Chain
caggugcagcugguggagagcggcggcggcguggugcagcccggcagaagccugagacugagcugcguggccagccaguucagcuucgacagauacggcaugcacugggugagacaggcccccggcaagggccuggaguggguggccagcaucagcuucgacggcaccgacaaguaccacgccgacaagguguggggcagauucaccaucagcagagacaacagcaagaacacccuguaccugcagaugaacagccugagacccgaggacaccgcccuguacuacugcgccaaggacaugagagaggacgagugcgaggccugguggagcgacuacuacgaccugggcaagcagcugcccugcagagagagcagaggcguggccggcaucuucgacgaguggggccagggcaccauggugaccgugagcagc

SEQ ID NO: 32414 - RNA, 432 nt, Artificial Sequence
  derived and/or modified sequence opt4 from anti-HIV_cap256-119-106327_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgccaucagcggcggcggcggcaacaccuacguggccgacagcgugaagggcagauucaccaucagcagagacaacagcaagaacaccguguaccugcagaugaacagccugagacuggaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32415 - RNA, 438 nt, Artificial Sequence
  derived and/or modified sequence opt4 from anti-HIV_cap256-119-105486_VR-Chain
caggugcagcugguggagagcggcggcggcguggugcagcccggcggcagccugagacugagcugcgccgccagcggcuucaccgugagcggcuacggcaugcacugggugagacaggcccccgccaagggccuggacuggguggccuucaucagccacgacggcagcaacaaguacuacgccgacagcgugagaggcagauucaucaucagcagagacaacagcaacaacacccuguacgugcagaugagcagccugagagccgaggacaccgcccuguacuucugcgugagagaccacagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32416 - RNA, 432 nt, Artificial Sequence
  derived and/or modified sequence opt4 from anti-HIV_cap256-119-105197_VR-Chain
caggugcagcugguggagagcggcggcggcguggugcagcccggcagaagccugagacugagcugcgccgugagccaguucaccuucggcagauacggcaugcacugggugagacaggcccccggcaagggccuggagugggugggcagcaucagcuacgacggcagcgacaaguaccacaccaacagccuguggggcagauucaucgugagcagagacaacagcaagaacacccuguaccugcagaugaacaaccugagacccgaggacaccgcccuguacuacugcgugagagacagaagagagagcgagugcgaggagagauggagcgacuacuacgacuucggcaagcagcugcccugcgugaagcccagaggcguggugggcgugcuggacaucuggggccagggcacccuggugaccgugagcagc

SEQ ID NO: 32417 - RNA, 432 nt, Artificial Sequence
  derived and/or modified sequence opt4 from anti-HIV_cap256-119-104946_VR-Chain
caggagcagcugguggagagcggcggcggcguggugcagcccggcagaagccugagacugagcugcguggccagcagauucaccuucagcgccuucggcaugcacugggugagacaggcccccggcaagggccuggaguggguggccagcaucagcuucgccggcaucaagaaguacuacggcgacagcgugaagggcagauucaccaucagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugcaucgacagcagaggcguggugggcauccuggacaucuggggccagggcaucauggugaccgugagcagc

SEQ ID NO: 32418 - RNA, 432 nt, Artificial Sequence
  derived and/or modified sequence opt4 from anti-HIV_cap256-119-103667_VR-Chain
caggugcaccugguggagagcggcggcggcguggugcagcccggcaagagccugagacugagcugcgccgccagccaguucaccuucaacagauucggcaugcacugggugagacaggcccccggcaagggccuggaguggguggccggcaucagcuacgacggcagcgacaaguaccacgccgacaagguguggggcagauucaccaucagcagagacaacagcaagaacacccuguaccugcagaugaacagccugagagccgaggacaccgcccuguacuacugcgccaaggaccugagagaggacgagugcgaggagugggccagcgacuacuacgacuucggcaaggagcagcccugccuggaccccagaggcguggugggcaucuucgacaucuggggccagggcaccauggugaccgugagcagc

SEQ ID NO: 32419 - RNA, 438 nt, Artificial Sequence
  derived and/or modified sequence opt4 from anti-HIV_cap256-119-103385_VR-Chain
gaggugcagcugguggagagcggcggcggccuggugcagaccggcggcagccugagacugagcugcgccgccagcggcuucaccuucagcagauacgacaugaacugggugagacaggcccccggcaagggccuggaguggguggccagcaucagcaacgacggcagcaagaaguaccacggcgacagcgugugggccagauucaccaucagcagagacaacagcaagaacacccuguuccugcagaugagcagccugagaguggaggacaccgcccuguacuucugcgugagagaccagagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32420 - RNA, 438 nt, Artificial Sequence
  derived and/or modified sequence opt4 from anti-HIV_cap256-119-103267_VR-Chain
gaggugcccagcguggagagcggcggcggccuggugcagaccggcggcagccugacccugagcugcgccgccagccaguucaccuucagcaacuacggcaugcacugggugagacaggcccccggcaagggccuggaguggguggccagcaucagcaacgacggcagcaagaaguaccacggcgacagcgugugggccagauucaucaucagcagagacaacagcaagaacacccuguuccugcagaugagcagccugagagccgaggacaccgcccuguacuucugcgugagagaccacagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32421 - RNA, 432 nt, Artificial Sequence
  derived and/or modified sequence opt4 from anti-HIV_cap256-119-103011_VR-Chain
caggugcagcugguggagagcggcggcggcguggugcagcccggcggcagccugagacugagcugcgccaccagcggcuucaccuucggcaccuucggcaugcacugggugagacaggcccccggcaagggccuggacuggguggccgccaucagcuucgccggcaccaagaagaacuacgccgacagcgugagaggcagauucaccaucagcagagacagcagcaagaacacccuguaccugcagaugaacagccugagacccgaggacaccgcccuguacuacugcgugaaggacaugagaggcuacgagugcgaggaguggaccagcgacuacuacgacuucggcagaccccagcccugcaucgacagcagaggcguggugggcaccuucgacguguggggccagggcaccauggugaccgugagcagc

SEQ ID NO: 32422 - RNA, 438 nt, Artificial Sequence
  derived and/or modified sequence opt4 from anti-HIV_cap256-119-102072_VR-Chain
gaggugcagcugguggagagcggcggcggccuggugcagcccggcggcagccugagagugagcugcgccgugagcggcuucaccuucagcaacuacgagaugaacugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacaucuggggccacggcaccauggugaccgugagcagc

SEQ ID NO: 32423 - RNA, 438 nt, Artificial Sequence
  derived and/or modified sequence opt4 from anti-HIV_cap256-119-101945_VR-Chain
gaggugcagcugguggagagcggcggcggccuggugcagcccggcggcagccugagacugagcugcgccgccagcggcuucaccuucagcagcuacgugaugcacugggugagacaggcccccggcaagggccuggaguggguggccagcaucagcaacgacggcaccaagaaguaccacgaggagagcguguggggcagauucaccaucagcaaggacaacagcaagaacacccuguuccugcagaugaacagccugagaaucgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32424 - RNA, 432 nt, Artificial Sequence
  derived and/or modified sequence opt4 from anti-HIV_cap256-119-101319_VR-Chain
caggugcagcugguggagagcggcggcggcguggugcagcccggcaagagccugagacugagcugcgugggcagcggcuucaccuucgacgacuacggcaugcacugggugagacaggcccccggcaagggccuggaguggguggccagcaucagcuacgacggcagagacuucuaccacgccagaagcguguggggcagauucaccaucagcagagacaacagcaagaacacccugcaccugcagaugaacagccugagacccgaggacaccgcccuguacuucugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32425 - RNA, 432 nt, Artificial Sequence
  derived and/or modified sequence opt4 from anti-HIV_cap256-119-100871_VR-Chain
caggugcagcugguggagagcggcggcggcguggugcagcccggcgagagccugagaaucagcugcgccgccagccaguucaccuucagcagauacggcaugcacugggugagacaggcccccggcaagggccuggaguggguggccagcaucagcuucgacggcagagacaaguaccacagcagccugguguggggcagacugaccaucagcagagacaacagcaagagcacccuguuccugcagaugaacagccugagagccgaggacaccgcccuguacuacugcgccagagaccugagagagagcgagugcgaggagugggagagcgacuacuacgacuucggcaagccccagcccugcgaggaccccagaggcguggugggcaccuucgacauguggggccugggcacccuggugaccgugagcagc

SEQ ID NO: 32426 - RNA, 432 nt, Artificial Sequence
  derived and/or modified sequence opt4 from anti-HIV_cap256-119-100838_VR-Chain
gaggugcagcugguggagagcggcggcggcguggugcagcccggcggcagccugagacugagcugcgccgccagcggcuucaccuucagcagcuacggcaugcacugggugagacaggcccccggcaagggccuggaguggguggccuucaucagauacgacggcagcaacaaguacuacgccgacagcgugaagggcagauucaccaucagcagagacaacagcaaccacacccuguacaugcagcuggacagccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggagccagggcaccauggugaccgugagcagc

SEQ ID NO: 32427 - RNA, 438 nt, Artificial Sequence
  derived and/or modified sequence opt4 from anti-HIV_cap256-119-100025_VR-Chain
caggugcagcugguggagagcggcggcggcguggugcagcccggcagaagccugagacugagcugcgccgccagcguguucaccuucagcuacuacggcaugcacugggugagacaggcccccggcaagggccuggaguggguggccuucaucagccacgacggcagcaacaaguacuacgccgacagcgugagaggcagauucaucaucagcagagacaacagcaacaacacccuguacgugcagaugaacagccugagagccgaggacaccgcccuguacuucugcgugaaggaccagagagaggacgagugcgaggagugguggagcgacuacuacgacuucggcagagagcugcccugcagaaaguucagaggccugggccuggccggcaccuucgacaucuggggccacggcaccaugcugaucgugagcagc

SEQ ID NO: 32428 - RNA, 432 nt, Artificial Sequence
  derived and/or modified sequence opt4 from anti-HIV_cap256-119-100000_VR-Chain
cagaugcagcugguggagagcggcggcggcguggugcagcccggcagaagccugacccugagcugcgccgccagccaguucaccuucagcaacuacggcaugcacugggugagacaggcccccggcaagggccuggaguggguggccagcaucagcaacgacggcaacaagaaguaccacggcgacagcgugugggccagauucaccaucagcagagacaacagcaagaacacccuguuccugcagaugagcagccugagaaccgaggacaccgcccuguacuucugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32429 - RNA, 432 nt, Artificial Sequence
  derived and/or modified sequence opt4 from anti-HIV_cap256-119-098890_VR-Chain
caggugcagcugguggagagcggcggcggcguggugcagcccggcgagagccugagaaucagcugcguggccagccaguucaccuucggcagauacggcaugcacugggugagacaggcccccggcaagggccuggaguggguggccagcaucagcuucgacggcagagacaaguaccacagcccccugguguggggcagacugaccaucagcagagacaacagcaagaacacccuguuccugcagaugaacagccugagaaccgaggacaccgcccuguacuacugcgccagagaccugagagagagcgagugcgaggagugggagagcgacuacuacgccuucuggagaaagcugcccugcgugaagcccagaggcguggccggcacccuggacaucuggggccagggcaccauggugagcgugagcagc

SEQ ID NO: 32430 - RNA, 435 nt, Artificial Sequence
  derived and/or modified sequence opt4 from anti-HIV_cap256-119-098715_VR-Chain
caggugcagcugguggagagcggcggcggcguggugcagcccggcagaagccugagacugagcugcgccgccagcggcuucagcuucaacaaccacggcaugcacugggugagacaggcccccggcaagggccuggaguggguggccggcaucagcuucgccggcaucaagaaguacuacggcaccagcgugaagggcagauucaccaucagcagagacaacagcaagaacaaccuguuccugcagaugaacagccugagaguggaggacaccgcccuguacuacugcgccagagaccugagagagauggagugcgaggaguggacccuguacaacuacuacgacuucggcagcagaggccccugcguggaccccagaggcguggugggcagcuucgacguguggggccagggcaccauggugaccgugagcagc

SEQ ID NO: 32431 - RNA, 438 nt, Artificial Sequence
  derived and/or modified sequence opt4 from anti-HIV_cap256-119-098632_VR-Chain
cagaugcagcugguggagagcggcggcggcguggugcagcccggcagaagccugacccugagcugcgccgccagccaguucaacuucgccaacuacgacaugcacugggugagacaggcccccggcaagggccuggaguggguggccuucaucagauacgacggcaacaacaaguacuacgccgacagcgugaagggcagauucaccaucagcagagacaacagcaagagcacccuguuccugcagaugaacagccugagaaucgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32432 - RNA, 432 nt, Artificial Sequence
  derived and/or modified sequence opt4 from anti-HIV_cap256-119-097199_VR-Chain
caggugcagcugguggagagcggcggcggcguggugcagcccggcagaagccugagacugagcugcgccgccagcggcuucgccuucagcagcuacgccuuccacugggugagacaggcccccggcaagggccuggaguggguggccuacauccccuuccacggcaaccagcaguacuacggcgacagcgugaagggcagauucaccaucagcagagacaacagcagagacacccuguuccuggagaugaacagccugagacccgaggacaccgcccuguacuucugcgccagagaccagagauacuacgagugcgaggagugggccagcgacuacuacgacuucggcagagagcagcccugccuggaccccagaggcguggugggcaucuucgaccuguggggccagggcaccauggugaccgugagcagc

SEQ ID NO: 32433 - RNA, 432 nt, Artificial Sequence
  derived and/or modified sequence opt4 from anti-HIV_cap256-119-096189_VR-Chain
caggugcagcugguggagagcggcggcggcguggugcagcccggcagaagccugagacugagcugcgccgccagcggcuucaaguucggcagcuucggcaugcacugggugagacaggcccccggcaagggccuggaguggguggccgugaucagcuacgacggcagcgacaaguacuacggcagcagcgugagaggcagauucagcaucagcagagacaacagcaagaacacccuguaccugcagaugaacagccugagaaccgaggacaccgcccuguacuucugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32434 - RNA, 432 nt, Artificial Sequence
  derived and/or modified sequence opt4 from anti-HIV_cap256-119-094581_VR-Chain
caggugcaccugguggagagcggcggcggcguggugcagcccggcagaagccugagacugagcugcgccgccagcggcuucaacuucagcaacuacgccauccacugggugagacagacccccggcaagggccuggagugggugacccugaucagcaacgacggcagcaacaaguacuacgccgacagccugaagggcagauucaccaucagcagagacaacagcaagaacacccuguaccugcagaugaacagccugagagccgaggacaccgcccuguacuacugcgccaaggaccugagagaggacgagugcgaggagugguggagcgacuacuacgacuucggcaagcagcugcccugcagaaagagcagaggcguggccggcaucuucgacggcuggggccagggcaccauggugaccgugagcagc

SEQ ID NO: 32435 - RNA, 432 nt, Artificial Sequence
  derived and/or modified sequence opt4 from anti-HIV_cap256-119-094200_VR-Chain
gaggugcagcugguggagagcggcggcggccuggugcagcccggcggcagccugagacugagcugcgccgccagcggcuucaucuucagcagcuacgcccugcacugggugagacaggcccccggcaagggccuggaguggguggccagcaucagcuucgccggcaccaagaaccacuacggcaacagcgugaagggcagauucaccaucagcagagacaacagcaagaacaccguguaccugcagaugaacagccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggagccagggcaccauggugaccgugagcagc

SEQ ID NO: 32436 - RNA, 432 nt, Artificial Sequence
  derived and/or modified sequence opt4 from anti-HIV_cap256-119-094158_VR-Chain
cagaugcagcugguggagagcggcggcggcguggugcagcccggcagcagccugacccugagcugcgccgccagccaguucaccuucagcaacuacggcaugcacugggugagacaggcccccggcaagggccuggaguggguggccagcaucagcaacgacggcaccaagaaguaccacggcgacagcgugugggacagauucaccaucagcagagacaacagcaagaacacccuguuccugcagaugaacagccugagagccgaggacaccgcccuguacuucugcgugaaggaccagagagaggacgagugcgaggagugguggagcgacuacuacgacuucggcaagcagcugcccugcagaaagagcagaggcguggccggcaucuucgacagcuggggccagggcaccauggugaccgugagcagc

SEQ ID NO: 32437 - RNA, 432 nt, Artificial Sequence
  derived and/or modified sequence opt4 from anti-HIV_cap256-119-092814_VR-Chain
caggugcagcugguggaguucggcggcggcguggugcagcccggcggcagccugagacugagcugcgccgccagcggcuucuacuucaccgacuacggcaugcacugggugagacaggcccccggcgagggccugcaguggguggccuucaucagcuacgacggcaacaccaagaccaccgccgacagcgugagaggcagauucacccugagcagagacaacagcaagaacacccuguaccugcagaugaacagcgugagaguggaggacaccgccagauacuucugcgccagagacaugagagaguacgagugcgagcugugggccagcgacuacuacgacuucggcaagccccagcccugcgaggaccccagaggcguggugggcaccuucgacauguggggccugggcacccuggugaccgugagcagc

SEQ ID NO: 32438 - RNA, 432 nt, Artificial Sequence
  derived and/or modified sequence opt4 from anti-HIV_cap256-119-092808_VR-Chain
caggugcagcugguggagagcggcggcggcguggugcagcccggcagaagccugagacugagcugcgccgccagccaguucagcuucggcaacuacggcaugcacugggugagacaggcccccggcaagggccuggaguggguggccgccaucagcuucgccggcaccaagaccaacuacgccgacagcgugaagggcagauucaccaucagcagagacaacagcaagaacaccguguaccugcagaugaacagccugagagccgaggacaccgcccuguacuucugcgccaaggacaucagagaguacgagugcgaguacuggaccagcgacuacuacgacuucggcagaccccagcccugcaucgacagcagaggcguggugggcaccuucgacguguggggccagggcaccauggugaccgugagcagc

SEQ ID NO: 32439 - RNA, 432 nt, Artificial Sequence
  derived and/or modified sequence opt4 from anti-HIV_cap256-119-092573_VR-Chain
caggagcagcugguggagagcggcggcggcguggugcagcccggcaccagccugagacugagcugcagcgccagcggcuucaccuucagcaacuucgccaugaacugggugagacaggcccccggcaagggccuggagugggugagcuucaucagcagcgacggcaagaacaagaacuacguggacagcgugaagggcagauucaccaucagcagagacaacuacaagaacacccuguaccugcagaugaacagccugagaaccgaggacaccgccguguacuacugcgccaaggaccugggcggcaccaaggacgacgagugggccaccgacuacuacgacuggagcaccgccuaccccgugcaggaccccagagccguggccggcggcuucgaccuguggggccugggcaccauggugaccgugagcagc

SEQ ID NO: 32440 - RNA, 432 nt, Artificial Sequence
  derived and/or modified sequence opt4 from anti-HIV_cap256-119-090815_VR-Chain
caggugcagcugguggagagcggcggcggcgugguggagcccggcagaagccugagacugagcugcgccgccagccaguucagcuucagcagcuacggcaugcacugggugagacaggcccccggcaagggccuggaguggguggccgccaucagcuucgacggcgccgacaaguaccacgccgacaacguguggggcagacugagcaucagcagagacaacagcaagagcacccuguaccugcagaugaacagccugagacccgaggacaccgccguguacuucugcgccaaggaccugagagaggacgagugcgaggagagauggagcgacuacuacgacuucggcaagcagcugcccugcagaaagagcagaggcguggccggcaucuucgacaacuggggccagggcaccauggugaccgugagcgcc

SEQ ID NO: 32441 - RNA, 438 nt, Artificial Sequence
  derived and/or modified sequence opt4 from anti-HIV_cap256-119-090368_VR-Chain
caggugcagcugguggagagcggcggcggcguggugcagcccggcagaagccugagacugagcugcgccgccagcggcuucgccuucagccacuacggcaucuucugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32442 - RNA, 432 nt, Artificial Sequence
  derived and/or modified sequence opt4 from anti-HIV_cap256-119-089710_VR-Chain
caggugcagcugguggagagcggcggcggcguggugcagcccggcagaagccugagacugagcugcaccgccagcggcuucggcuucagcaacuacgccaugcacugggugagacuggcccccggcaagggccuggaguggguggccagcaucagcuacgacggcagagacuaccaccacgccggcgccguguggggcagauucaucaucagcagagacaacagcaagaacagccugcaccugcagaugaacagccugagacccgaggacaccgcccuguacuucugcgccagagaccugagagagagcgagugcgaggagugggagagcgacuacuacaacuucuggaagaagcugcccugcgugaagcccagaggcguggugggcauccuggacaucuggggccagggcaccguggugaccgugagcagc

SEQ ID NO: 32443 - RNA, 432 nt, Artificial Sequence
  derived and/or modified sequence opt4 from anti-HIV_cap256-119-088555_VR-Chain
caggugcagcugguggagagcggcggcggcguggugcaggccggcagaagccugagacugagcugcgccgccagccaguucaccuucagcagauacggcaugcacugggugagacaggcccccggcaagggccuggaguggguggccggcaucagcuacgacggcagagacaaguaccacgcccacuucguguggggcagauucaucaucagcagagacaacagcaagaacacccuguaccugcagaugaacagccugagagccgaggacaccgcccuguacuacugcgugagagaccugagagagagcgagugcgagcugugggagagcgacuacuacgacuucggcaagagacugcccugcgugaagcccagaggcguggccggcaccuucgaccuguggggccagggcaccauggugaccgugagcagc

SEQ ID NO: 32444 - RNA, 432 nt, Artificial Sequence
  derived and/or modified sequence opt4 from anti-HIV_cap256-119-087962_VR-Chain
gagaugcagcugguggagagcggcggcggccuggugaagcccggcagaagccugagacugagcugcgccgccagcggcuucaccuucagcagcuacgccauccacugggugagacaggcccccggcaagggccuggaguggguggccgugaucagcuacgacggcagcaacaaguacuacgccgacagcgugaagggcagauucaccaucagcagagacaacagcaagaacaccguguaccugcagaugaacagccugagaguggaggacaccgcccuguacuacugcgccaaggaccugagagaguacgagugcgaggaguggaccagcgacuacuacgacuucggcaagccccagcccugcaucgacagcagaggcguggugggcauccuggacaucuggggccagggcaucauggugaccgugagcagc

SEQ ID NO: 32445 - RNA, 432 nt, Artificial Sequence
  derived and/or modified sequence opt4 from anti-HIV_cap256-119-086903_VR-Chain
caggugcaccugguggagagcggcggcggcguggugcagcccggcaagagccugagacugagcugcgccgccagccaguucaccuucgacagauacggcaugcacugggugagacaggcccccggcaagggccuggaguggguggccagcaucagcaacgacggcaccgacaaguaccacgccgacaacguguggggcagauucaccaucagcagagacaacagcaagaacacccuguaccuggagaugaacagccugagaggcgaggacaccgcccuguacuacugcgccaaggacaugagagaggacgagugcgaggagugguggagcgacuacuacgacuucggcagaccccagcccugcaucgacagcagaggcguggugggcaccuuccacguguggggccagggcaccauggugaccgugagcagc

SEQ ID NO: 32446 - RNA, 432 nt, Artificial Sequence
  derived and/or modified sequence opt4 from anti-HIV_cap256-119-086804_VR-Chain
gaggugcagcugguggagagcggcggcggcguggugcagcccggcagaagccugagacuguucugcgccggcagcggcuucaccuucagcagcuacggccugcacugggugagacaggcccccggcaagggccuggagugggugagcuucaucagcuacgacggcagcaccaccaaguacgccgacagccugaagggcagauucaccgugagcagagacaacagcaagaacaccguguaccuggagaugaacagccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32447 - RNA, 432 nt, Artificial Sequence
  derived and/or modified sequence opt4 from anti-HIV_cap256-119-085910_VR-Chain
gaggugcagcugcuggagagcggcggcggccuggugcagcccggcggcagccugagacugagcugcgccgccagcggcuucaccuucagcagcuacggcaugcacugggugagacaggccgccggcaagggccuggaguggguggccagcaucagcuacgacggcagagacuaccaccacgccggcgccguguggggcagauucaucaucagcagagacaacagcaagaacagccugcaccugcagaugaacagccugagacccgaggacaccgcccuguacuucugcgccagagaccugagagagagcgagugcgaggagugggagagcgacuacuacaacuucuggaagaagcugcccugcgugaagcccagaggcguggugggcauccuggacaucuggggccagggcaccguggugaccgugagcagc

SEQ ID NO: 32448 - RNA, 432 nt, Artificial Sequence
  derived and/or modified sequence opt4 from anti-HIV_cap256-119-085772_VR-Chain
gaggugagacugguggagagcggcggcggccugauccagcccggcggcagccugagacugagcugcgccgccagcggccugaccgugagcagcaaccacaugagcugggugagacaggcccccggcaagggccuggaguggguggccgugaucagcuacgacggcagcaacaccuucuacggcgacagcgugaagggcagauucaccgugagcagagacaucagcaagaacacccuguaccugcagaugaacagccugagacccgaggacaccgccauguacuacugcgccagagaccagagauacuacgagugcgaggagugggccagcgacuacuacgacuucggcagagagcagcccugccaggaccccagaggcguggugggcguguucgacauguggggccagggcaccauggugaccgugagcagc

SEQ ID NO: 32449 - RNA, 432 nt, Artificial Sequence
  derived and/or modified sequence opt4 from anti-HIV_cap256-119-084603_VR-Chain
caggugcagcugguggagagcggcggcggcguggugcagagcggcagaagccugagacugagcugcgccgccagcggcuuccccuucagcgacuucgccaugcacugggugagacaggcccccggcaagggccuggaguggguggccagcaucagcuucgugggcaucaagacccacuacgccaacagcgugagaggcagauucaccaucagcagagaccagagcaagaacacccuguaccugcagaugaacagcgugagaguggaggacaccggcagauacuacugcgccagagacaugagagaguacgagugcgagcugugggccagcgacuacuacgacuucggcaagccccagcccugcgaggaccccagaggcguggugggcaccuucgacauguggggccugggcacccuggugaccgugagcagc

SEQ ID NO: 32450 - RNA, 432 nt, Artificial Sequence
  derived and/or modified sequence opt4 from anti-HIV_cap256-119-084276_VR-Chain
caggugcagcugguggagagcggcggcggcguggugcagcccggcagaagccugagacugagcugcgccgccagcagauucaccuucagcagcuacgccaugcacugggugagacaggcccccggcaagggccuggaguggguggccgugaucugguacgacggcagcaacaaguacuacgccgacagcgugagaggcagauucagcgugagcaccgacaucagcaagaacacccuguaccugcagaugaacagccugagacccgccgacaccgcccuguacuucugcgccagagaccugagauacuacgagugcgaggagugggccagcgacuacuacgacuucggcaaggagcagcccugccuggaccccagaggcguggugggcaucuucgaccuguggggccagggcaccauggugaccgugagcagc

SEQ ID NO: 32451 - RNA, 432 nt, Artificial Sequence
  derived and/or modified sequence opt4 from anti-HIV_cap256-119-082288_VR-Chain
cagguguaccugguggagagcggcggcggcguggugcagcccggcagaagccugagacugagcagcgccgccagccacuucagccugagcagcuacggcaugcacugggugagacaggcccccggcaagggccuggaguggguggccggcaucagcuucgccggcaccaagaccuacuacggcgacagcgugaagggcagauucaccgugagcaccgacaucagcaagaacacccuguaccugcaggugaacagccugagacccgaggacaccgccauguacuacugcgccagagaccagagauacuacgagugcgaggagugggccagcgacuacuacgacuucggcaaggagcagcccugccuggaccccagaggcguggugggcaucuucgacaucuggggccagggcaccauggugaccgugagcagc

SEQ ID NO: 32452 - RNA, 432 nt, Artificial Sequence
  derived and/or modified sequence opt4 from anti-HIV_cap256-119-080383_VR-Chain
caggugcagcugguggagagcggcggcggcguggugcagcccggcagaagccugagaaucagcugcgccgccagccaguucaccuucagcagauacggcaugcacugggugagacaggcccccggcaagggccuggaguggguggccagcaucagcuacgacggcaccgacaaguaccacgccagacugguguggggcagauucaccaucagcagagacaacagcaagaacacccuguaccugcagaugaacagccugagagccgaggacaccgcccuguacuacugcgugagagacgagagagagagcgagugcgagcugugggagagcgacuacuacgacuucggcaagaagcugcccugcgugaagcccagaggcgugaccggcagccuggacauguggggccagggcacccaggugaccgugagcagc

SEQ ID NO: 32453 - RNA, 438 nt, Artificial Sequence
  derived and/or modified sequence opt4 from anti-HIV_cap256-119-079333_VR-Chain
gaggugcagcugguggagagcggcggcagacuggugcagcccggcagcccccugagacugagcugcgccgccagccaguucaacuucgccagcuacggcaugcacugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32454 - RNA, 441 nt, Artificial Sequence
  derived and/or modified sequence opt4 from anti-HIV_cap256-119-078618_VR-Chain
cagaugcagcugguggagagcggcggcggcguggugcagcccggcagaagccugacccugagcugcgccgccagccaguucaacuucgccagcuacggcaugcacugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccacccuguacuucugcgugaaggaccagagagaggacgagugcgaggagugguggagcgacuacuacgacuucggcagagagcugcccugcagaaagagcagaggccugggccuggccggcaacuucugcaucugcggcgccgacggcaccauggugaccgugagcagc

SEQ ID NO: 32455 - RNA, 432 nt, Artificial Sequence
  derived and/or modified sequence opt4 from anti-HIV_cap256-119-077466_VR-Chain
caggugcagcugguggagagcggcggcggcguggugcagcccggcagcccccugagaaucagcugcgccgugagccaguucaccuucagcagauacggcaugcacugggugagacaggcccccggcaagggccuggaguggguggccagcaucagcuucgacggcagagacaaguaccacagcagccugguguggggcagacugaccaucagcagagacaacagcaagagcacccuguuccugcagaugaacagccugagagccgaggacaccgcccuguacuacugcgccagagaccugagagagagcgagugcgaggagugggagagcgacuacuacgccuucuacagaaagcugcccugcgugaagcccagaggcguggccggcacccuggacaucuggggccagggcaccauggugaccgugagcagc

SEQ ID NO: 32456 - RNA, 423 nt, Artificial Sequence
  derived and/or modified sequence opt4 from anti-HIV_cap256-119-076284_VR-Chain
caggugcagcugguggagagcggcggcggcguggugcagcccggcagaagccugagacugagcugcgccgccagcaacaccuacgccaugcacugggugagacaggcccccggcaagggccuggaguggauggcccugaucagcuacgagggcagcgacaaguacuacguggacagcgugaagggcagauucaccaucagcagagacaacagcaagagcacccuguaccugcagaugaacagccugagcgccgaggacaccgccguguacuucugcgccaaggaccugggcggcaacaaggacgacgaguggaccaccgacuacuacuacgacuggagcaaggccagacccgugcaggaccccagagugguggccggcaccuucgacaucuggggccagggcaccauggugaccgugagcagc

SEQ ID NO: 32457 - RNA, 432 nt, Artificial Sequence
  derived and/or modified sequence opt4 from anti-HIV_cap256-119-074680_VR-Chain
gaggugcagcugguggagagcggcggcggccuggugcagcccggcagaagccugagacugagcugcgccggcagcggcuucaccuucguggacuacgccaugcacugggugagacaggugcccggcaagggccuggagugggugggcagcaucagcuacgacggcagcgacaaguaccacaccaacagcguguggggcagauucaucgugagcagagacaacagcaagaacacccuguaccugcagaugaacagccugagacccgaggacaccgcccuguacuacugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32458 - RNA, 432 nt, Artificial Sequence
  derived and/or modified sequence opt4 from anti-HIV_cap256-119-074081_VR-Chain
gaggugcagcugguggagagcggcggcggccuggugcagcccggcggcagccugagacugagcugcguggugagcggcgugaccgugagcagcaacuacaugagcugggugagacaggcccccggcaagggccuggaguggguggccagcaucagcuacgacggcagcgacaaguaccacgccgacagaguguggggcagauucaccaucagcagagacaacagcaagaacacccuguaccugcagaugaacagccugagagccgaggacaccgcccuguacuacugcgugagagacgccagagagagcgagugcgagcugugggagagcgacuacuacaacuucggcagaaagcugcccugcgugaagcccagaggcguggccggcacccuggacaucuggggccagggcaccauggugaccgugagcagc

SEQ ID NO: 32459 - RNA, 432 nt, Artificial Sequence
  derived and/or modified sequence opt4 from anti-HIV_cap256-119-071704_VR-Chain
cagaugcagcugguggagagcggcggcggcguggugcagcccggcggcagccugagacugagcugcgccgugagccaguucaccuucaccagcuacggcaugcacugggugagacaggcccccggcaagggccuggaguggguggccaccaucagcagcgacggcagcaagaaguaccacggcgacagcguguggggcagacugaccaucagcagagacaacagcaagaacacccuguuccugcagaugaacaaccugagagccgaggacaccgcccuguacuucugcgugaaggaccagagagaggacgagugcgaggagugguggagcgacuacuacgacuucggcaagaagcugcccugcagaaagagccccggccuggccggcaucuucgacguguggggccacggcaccauggugaccgugagcccc

SEQ ID NO: 32460 - RNA, 432 nt, Artificial Sequence
  derived and/or modified sequence opt4 from anti-HIV_cap256-119-071266_VR-Chain
caggugcagcugguggagagcggcggcggcguggugcagcccggcgagagccugagacugagcugcgccgccagcggcuucaccuucagcagcuucggcaugcacugggugagacaggcccccggcaagggccuggagugggugggcagcaucagcuacgacggcagcgacaaguaccacaccaacagcguguggggcagauucaucgugagcagagacaacagcaagaacacccuguaccugcagaugaacagccugagacccgaggacaccgcccuguacuacugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32461 - RNA, 432 nt, Artificial Sequence
  derived and/or modified sequence opt4 from anti-HIV_cap256-119-069667_VR-Chain
gaggugcagcugguggagagcggcggcggccuggugcagcccggcagaagccugagacugagcugcgccgccagcggcuucagcuucaacaccuacggcaugcacugggugagacaggcccccggcaagggccuggaguggguggccuucaucagauacgacggcagcaacaaguacuacgccgacagcgugaagggcagauucaccaucagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32462 - RNA, 432 nt, Artificial Sequence
  derived and/or modified sequence opt4 from anti-HIV_cap256-119-069591_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccggcaucagcuacgacggcagcgacaaguaccacgccgacaagguguggggcagauucaccaucagcagagacaacagcaagaacacccuguaccugcagaugaacagccugagagccgaggacaccgcccuguacuacugcgccaaggaccugagagaggacgagugcgaggagugguggagcgacuacuacgacuucggcaagagacugcccugcagaaagagcagaggcguggccggcguguucgacaaguggggccagggcaccauggugaccgugagcagc

SEQ ID NO: 32463 - RNA, 432 nt, Artificial Sequence
  derived and/or modified sequence opt4 from anti-HIV_cap256-119-068691_VR-Chain
cagggccaccugguggccagcggcggcggcguggugccccccggcagaagccugacccugagcugccuggccagccaguucaccuucagcggcuacggcuuccacugggugagacaggcccccggcaagggccuggaguggguggccagcaucagcuucgccggcaccaagaagcacuacggcaacagcgugaagggcagauucaccaucagcagagacaacagcaagaacacccuguaccuggagaugaacagccugagacccgaggacaccgcccuguacuacugcgccaaggacagaagagaguacgagugcgaggaguggaccagcgacuacuacgacuucggcagaccccagcccugcaucgacagcagaggcguggugggcauccuggacaucuggggcagaggcaccauggugaccgugagcagc

SEQ ID NO: 32464 - RNA, 432 nt, Artificial Sequence
  derived and/or modified sequence opt4 from anti-HIV_cap256-119-068488_VR-Chain
cagaugcagcugguggagagcggcggcggcguggugcagcccggcaugagccugacccugagcugcgccgccagccaguucaccuucagcaacuacggcaugcacugggugagacaggcccccggcaagggccuggaguggguggccagcaucagcaacgacggcagcaagaaguaccacggcgacagcgugaagggcagauucaccaucagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32465 - RNA, 432 nt, Artificial Sequence
  derived and/or modified sequence opt4 from anti-HIV_cap256-119-067536_VR-Chain
caggugcagcugguggagagcggcggcggcguggugcagcccggcagaagccugagaaucagcugcgccagcagccaguucaccuucagcagauacggcaugcacugggugagacaggcccccggcaagggccuggaguggguggccagcaucagcuacgacggcagagacuaccaccacgccggcgccguguggggcagauucaucaucagcagagacaacagcaagaacagccugcaccugcagaugaacagccugagacccgaggacaccgcccuguacuucugcgccagagaccugagagagagcgagugcgaggagugggagagcgacuacuacgccuucuacagaaagcugcccugcgugaagcccagaggcguggccggcacccuggacaucuggggccagggcaccauggugaccgugagcagc

SEQ ID NO: 32466 - RNA, 432 nt, Artificial Sequence
  derived and/or modified sequence opt4 from anti-HIV_cap256-119-065852_VR-Chain
caggugcaccugguggagagcggcggcggcgccgugcccagcggcagaagccugagacugagcugcguggccagcggcuucaccuucggcguguacgacauccacugggugagacaggcccccggcaagggccuggaguggguggccagcaucagcuacgacggcagagacaaguaccacagcagccugguguggggcagacugaccaucagcagagacaacagcaagagcacccuguuccugcagaugaacagccugagagccgaggacaccgcccuguacuacugcgccagagaccugagagagagcgagugcgaggaguggcagagcgacuacuacgccuucuacaagaagcugcccugcgugaagcccagaggcguggccggcacccuggacaucuggggccagggcaccauggugaccgugagcagc

SEQ ID NO: 32467 - RNA, 432 nt, Artificial Sequence
  derived and/or modified sequence opt4 from anti-HIV_cap256-119-065457_VR-Chain
cugggcagacugguggccagcggcggcggcguggugccccccggcagaagccccagacugagcugcguggccagccaguucaccuucagcggcugcggccugcacugggugagacaggcccccggcaagggccuggaguggguggccgccaucagcuucgacggcaccgacaaguaccacagcgacgacguguggggcagauucaccaucagcagagacaacagcaagaacacccuguaccugcagaugaacagccugagacccgaggacaccgcccuguacuacugcgccaaggaccugcaggaggacgagugcgaggagugguggagcgacuacuacgacuucggcaagcagcugcccugcagaaagagcagaggcguggccggcaucuucgacgacuggggccagggcaccauggugaccgugagcagc

SEQ ID NO: 32468 - RNA, 432 nt, Artificial Sequence
  derived and/or modified sequence opt4 from anti-HIV_cap256-119-064501_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccggcaucagcuacgacggcagagacaaguaccacgcccacagcguguggggcagacugagcaucagcagagacaacagcaagaacacccuguaccugcagaugaacagccugagaaccgaggacaccgcccuguaccacugcgugagagaccugagagagagcgagugcgagcugugggagagcgacuacuacgacuucggcaagaagcugcccugcgugaagcccagaggcguggccggcaccuucgaccuguggggccagggcaccauggugaccgugagcagc

SEQ ID NO: 32469 - RNA, 432 nt, Artificial Sequence
  derived and/or modified sequence opt4 from anti-HIV_cap256-119-063568_VR-Chain
caggugcagcccguggagagcggcggcggcgugguguggcccggcagaagccugagacugagcugcaccaccagcggcuucaccuucagcaacuacgccauccacugggugagacaggcccccggcaagggccugcaguggguggccgugaucagcuacgacggcagcaacaaguucuacgccgacagcgugaagggcagauucaccaucagcagagacaacagcaagaacacccuguaccugcagaugaacagccugagacccgaggacaccgcccuguacuacugcgccaaggaccugagagaggacgagugcgaggagagauggagcgacuacuacgacuucggcaagcagcugcccugcagaaagagcagaggcguggccggcguguucgacaacuggggccagggcaccauggugaccgugagcagc

SEQ ID NO: 32470 - RNA, 435 nt, Artificial Sequence
  derived and/or modified sequence opt4 from anti-HIV_cap256-119-063103_VR-Chain
caggugcagcugguggagagcggcggcggccuggugcagcccggcaagagccugagacugagcugcgccgccagcggcuucaccuucagcaccuacggcaugcacugggugagacaggcccccggcaagggccuggaguggguggcccugaucagcuacgacggcagcuacaccuacuacgccgacagcgugaagggcagauucaccaucagcagagacaacagcaagagcacccuggaccugcagcugaacacccugagacccgaggacaccgcccuguacuacugcgccagagaccugagagagauggagugcgaggaguggaagcuguacaacuacuacgacuucagaaccagaggccccugcguggaccccagaggcguggugggcagcuucgacguguggggccagggcaccguggugaccgugagcagc

SEQ ID NO: 32471 - RNA, 432 nt, Artificial Sequence
  derived and/or modified sequence opt4 from anti-HIV_cap256-119-061027_VR-Chain
caggugcagcugguggagagcggcggcggcguggugcagcccggcagaagccugagacugagcugcagcgccagcggcuucacccugagcagcuacggcauccacugggugagacaggcccccggcaagggccuggaguggguggccgugaugagcaacgacggcagcaaccaguucuacggcgacagcgugaagggcagauucaccaucagcagagacaucagcaagaacacccuguaccugcagaugaacagccugagacccgaggacaccgccauguacuacugcgccagagaccagagauacuacgagugcgaggagugggccagcgacuacuacgacuucggcagagagcagcccugccaggaccccagaggcguggugggcguguucgacauguggggccagggcaccauggugaccgugagcagc

SEQ ID NO: 32472 - RNA, 432 nt, Artificial Sequence
  derived and/or modified sequence opt4 from anti-HIV_cap256-119-058232_VR-Chain
caggugcagcugguggagagcggcggcggcguggugcagcccggcaagagccugagacugagcugcaaggccagccaguucaccuucaacagauacggcaugcacugggugagacaggcccccggcaagggccuggaguggguggccgccaucagcuucgacggcaccgacaaguaccacgccgacaagguguggggcagauucaccaucagcagagacgacagcaagagcacccuguaccugcagaugaacagccugagagccgaggacaccgcccuguacuacugcgccaaggaccugagagaggacgagugcgaggagugguggagcgacuacuacgacuucggcaagcagcugcccugcagaaagagcagaggcguggccggcaucuucgacggcuggggccagggcaccauggugaccgugagcagc

SEQ ID NO: 32473 - RNA, 432 nt, Artificial Sequence
  derived and/or modified sequence opt4 from anti-HIV_cap256-119-057341_VR-Chain
caggugcagcugguggagagcggcggcggcguggugcagcccggcagaagccugagacugagcugcgccgccagccacuucagccugagcagcuacggcaugcacugggugagacaggcccccggcaagggccuggaguggguggccggcgagagcuucgccgccaccaacaaguacuacgccgacagcgugaagggcagauucaucgugagcagagacaucagcaagaacacccuguaccuggaggugaacagccugagagccgaggacaccgcccuguacuacugcgccagagaccagagauacuacgagugcgaggagugggccagcgacuacuacgacuucggcagagagcagcccugccaggaccccagaggcguggccggcaucuucgacaucuggggccagggcaccauggugaccgugagcagc

SEQ ID NO: 32474 - RNA, 438 nt, Artificial Sequence
  derived and/or modified sequence opt4 from anti-HIV_cap256-119-056895_VR-Chain
cagaugcagcugguggagagcggcggcggcguggugcagcccggcagaagccugagacugagcugcgccgccagccaguucaccuucggcagcuacggcaugcacugggugagacagauccccggcaagggccuggaguggguggccaccaucagcuacgacggcaccaagaaguaccacgccgacagcgugugggacagauucaucaucagcagagacaacagcaagaacacccuguuccugcagaugaacagccugagacccgaggacaccgcccuguacuucugcgugaaggaccagagacaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32475 - RNA, 432 nt, Artificial Sequence
  derived and/or modified sequence opt4 from anti-HIV_cap256-119-056402_VR-Chain
caggugaagcugguggagagcggcggcggcguggugcagcccggcaagagccugagacugagcugcaccgccagccaguucaccuucagcaacuucggcaugcacugggugagacaggcccccggcaagggccuggaguggguggccagcaucagcuucgugggcaucaagaagcacuacgccaacagcgugagaggcagauucaccaucagcagagaccagagcaagaacacccuguaccugcagaugaacagcgugagaguggaggacaccgccagauacuucugcgccagagacaugagagaguacgagugcgagcugugggccagcgacuacuacgacuucggcaagccccagcccugcgaggaccccagaggcguggugggcaccuucgacauguggggccugggcacccuggugaccgugagcagc

SEQ ID NO: 32476 - RNA, 432 nt, Artificial Sequence
  derived and/or modified sequence opt4 from anti-HIV_cap256-119-056034_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgccaucagcuucgccggcaccaagacccacuacgccgacagcgugaagggcagauucaccaucagcagagacaacagcaagaacgcccuguaccugcagaugaacaaccugagagccgaggacaccgcccuguacuacugcgccaaggaccugagagaggacgagugcgaggagagauggagcgacuacuacgacuucggcaagcagcugcccugcagaaagagcagaggcguggccggcguguucgacaacuggggccagggcaccauggugaccgugagcagc

SEQ ID NO: 32477 - RNA, 432 nt, Artificial Sequence
  derived and/or modified sequence opt4 from anti-HIV_cap256-119-055042_VR-Chain
caggugcagcugguggagagcggcggcggcguggcccagcccggcagaagccugagacugagcugcgccgccagcggcuucaccuucagaagcuacggcaugcacugggugagacaggcccccggcaagggccuggaguggguggccgugaucagccuggacggcagcaacaaguacuacgccgacagcgugaagggcagauucagcaucagcagagacaacagcaagaacacccuguaccugcagaugaacagccugagacccgaggacaccgccguguacuacugcgccaaggaccugagagaggacgagugcgaggagagauggagcgacuacuacgacuucggcaagcagcugcccugcagaaagagcagaggcguggccggcguguucgacaacuggggccagggcaccauggugaccgugagcagc

SEQ ID NO: 32478 - RNA, 438 nt, Artificial Sequence
  derived and/or modified sequence opt4 from anti-HIV_cap256-119-054776_VR-Chain
caggugcagcugauggagagcggcggcggcguggugcagcccggcagaagccugagacugagcugcaccgccagcggcuucaccuucagcagcuacagcaugcacugggugagacaggcccccggcaagggccuggaguggguggccaucaucagcuacgacgagagcaacaaguacuacgccgacagcgugcagggcagauucaccaucagcagagacaacagcaagaacacccuguuccugcagaugagcagccugagagccgaggacaccgcccuguacuucugcgugagagaccacagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32479 - RNA, 432 nt, Artificial Sequence
  derived and/or modified sequence opt4 from anti-HIV_cap256-119-054539_VR-Chain
cagaugcagcugguggagagcggcggcggcguggugcagcccggcggcagccugagacugagcugcgccgccagccaguucaccuucggcagcuacgccaugcacugggugagacagccccccggcgagagacccgaguggguggccaccaucagcuucgacggcaccaagaaguaccacgccgacagcguguggggcagauucaccaucagcagagacaacagcaagaacacccuguuccugcagaugaacagccugagacccgaggacaccgcccuguacuucugcgugaaggaccagagagaggacgccugcgaggagugguggagcgacuacuacgacuucggcaagaacugccuggccgagagccccggcgccuggcuggaguucuucuacguguggggccacggcaccauggugaccgugagcagc

SEQ ID NO: 32480 - RNA, 432 nt, Artificial Sequence
  derived and/or modified sequence opt4 from anti-HIV_cap256-119-054112_VR-Chain
caggugcagcugguggagagcggcggcggcguggugcaggccggcagaagccugagacugagcugcgccgccagcggcuucaccuucagcaccuacgccaugcacugggugagacaggcccccggcaagggccuggaguggguggccgugaucagcuacgacggcagcaacaaguacuacgccgacagcgugagaggcagauucaccaucagcagagacaacagcaagaacacccuguaccugcagaugaacagccugagagccgaggacaccgcccuguacuacugcgccaaggacaugagagaguacgagugcgaggaguggaccagcgacuacuacgacuucggcagaccccagcccugcaucgacagcagaggcguggugggcaccuuccacguguggggccagggcaccauggugaccgugagcagc

SEQ ID NO: 32481 - RNA, 432 nt, Artificial Sequence
  derived and/or modified sequence opt4 from anti-HIV_cap256-119-053339_VR-Chain
caggugcaccugguggagagcggcggcggcguggugcagcccggcagaagccugagacugagcugcgccgccagccacuucagccugagcagcuacggcaugcacugggugagacaggcccccggcaagggccuggagugggugaccggcaucagcuucgccggcaccaagaccuacuacggcgacagcgugagaggcagauucaccgugagcagagacaucagcaagaacacccugcugcugcagaugaacagccugagacccgacgacaccgccaucuacuacugcgccagagaccagagauacuacgagugcgaggagugggccagcgacuacuacgacuucggcaaggagcagcccugccuggaccccagaggcguggugggcaucuucgaccuguggggccagggcaccauggugaccgugagcagc

SEQ ID NO: 32482 - RNA, 432 nt, Artificial Sequence
  derived and/or modified sequence opt4 from anti-HIV_cap256-119-052404_VR-Chain
cagaugcagcugguggagagcggcggcggcguggugcagcccggcagaagccugacccugagcugcaucgccagccaguucaacuucgccagcuacggcaugcacugggugagacaggcccccggcaagggccuggaguggguggccagcaucagccacgacggcaccaagaaguaccacgccgagagcguguggggcagauucaccaucagcaaggacaacagcaagaacacccuguuccugcagaugaacagccugagaguggaggacaccgcccuguacuucugcgugaaggaccagagagaggacgagugcgaggagugguggagcgacuacuacgacuucggcaagcagcugcccugcagaaagagcagaggcguggccggcguguucgacaacuggggccagggcaccauggugaccgugagcagc

SEQ ID NO: 32483 - RNA, 432 nt, Artificial Sequence
  derived and/or modified sequence opt4 from anti-HIV_cap256-119-051123_VR-Chain
caggugcagcugguggagagcggcggcggcguggugcagcccggcggcagccugagacugagcugcgugggcagccaguucauccuguacagauacggcaugcacugggugagacaggcccccggcaagggccuggaguggguggccgccgugagcuucgacggcaccgacaaguaccacgccgacgacguguggggcagauucaccaucagcagagacaacagcaagaacauccuguaccugcagaugaacagccugagagccgaggacaccgcccuguacuacugcgccaaggaccugagagaggacgagugcgaggagugguggagcgacuacuacgaccugggcaagcagcugcccugcagaaagagcagaggcguggccggcguguucgacaaguggggccugggcaccauggugaccgugagcagc

SEQ ID NO: 32484 - RNA, 438 nt, Artificial Sequence
  derived and/or modified sequence opt4 from anti-HIV_cap256-119-051077_VR-Chain
gaggugcagcugguggagagcggcggcggcguggugcagagcggcagaagccugagacugagcugcgccgccagccacuucaccuucagcagauacggcaugcacugggugagacaggcccccggcaagggccuggaguggguggccagcaucagcuacgacggcagagacuucuaccacgccagaagcguguggggcagauucaccaucagcagagacaacagcaagaacacccuguuccugcagaugaacagccugagaaucgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32485 - RNA, 432 nt, Artificial Sequence
  derived and/or modified sequence opt4 from anti-HIV_cap256-119-050442_VR-Chain
caggcccagaugguggagagcggcggcggcguggugcagcccggcagaagccugagacugagcugcgccgccagcggcuucagcuucagcuacuucgccaugcacugggugagacaggcccccggcaagggccuggaguggguggccggcaucagcuucgccgccaccaagaccuacuacggcggcagcgugaagggcagauucaccgugagcagagacaucagcaagaacacccuguaccugcagaugaacagccugagacccgaggacaccgccauguacuacugcgccagagaccagagauacuacgagugcgaggagugggccagcgacuacuacgacuucggcagagagcagcccugccaggaccccagaggcguggugggcguguucgacauguggggccagggcaccauggugaccgugagcagc

SEQ ID NO: 32486 - RNA, 432 nt, Artificial Sequence
  derived and/or modified sequence opt4 from anti-HIV_cap256-119-049433_VR-Chain
caggugcagcugguggagagcggcggcggcguggugcagcccggcagaagccugagagugagcugcagagccagcggcuucgccuucagcagcuacgccaugcacugggugagacaggcccccgugaagggccuggaguggguggcccugaccagcagcgacggcgccgacaaguaccacgccgacgacguguggggcagauucaccaucagcagagacaacagcaagaacacccuguaccugcagaugaacagccugagacccgaggacaccgcccuguacuacugcgccaaggaccugagagaggacgagugcgaggagagauggagcgacuacuacgacuucggcaagcagcugcccugcagaaagagcagaggcguggccggcguguucgacaacuggggccagggcaccauggugaccgugagcagc

SEQ ID NO: 32487 - RNA, 432 nt, Artificial Sequence
  derived and/or modified sequence opt4 from anti-HIV_cap256-119-047532_VR-Chain
cugggcagacugguggccagcggcggcggcguggugccccccggcagaagccugacccugagcugcguggccagccaguucaccuucagcggcugcggccugcacugggugagacaggcccccggcaagggccuggaguggguggccagcaucagcuucgccggcaccaagaagcacuacaccaacagcgugagaggcagauucaccaucagcagagacaacagcaagaacaccguguaccugcagaugaacagccugagagccgaggacaccgcccuguacuacugcgccaaggacaugggcgaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32488 - RNA, 432 nt, Artificial Sequence
  derived and/or modified sequence opt4 from anti-HIV_cap256-119-047489_VR-Chain
caggugcaccugguggagagcggcggcggcguggugcagcccggcaagagccugagacugagcugcgccgccagccaguucaccuucaacagauucggcaugcacugggugagacaggcccccggcaagggccuggaguggguggccggcaucagcuacgacggcagcgacaaguaccacgccgacaagguguggggcagauucaccaucagcagagacaacagcaagaacacccuguaccugcagaugaacagccugagagccgaggacaccgcccuguacuacugcgccaaggaccugagagaggacgagugcgaggagugguggagcgacuacuacgacuucggcaagagacugcccugcagaaagagcagaggcguggccggcguguucgacaaguggggccagggcaccauggugaccgugagcagc

SEQ ID NO: 32489 - RNA, 438 nt, Artificial Sequence
  derived and/or modified sequence opt4 from anti-HIV_cap256-119-046020_VR-Chain
gaggugcagcugcugcagagcggcggcggccuggugcagcccggcggcagccugagacugagcugcgccgccagcggcuucagcuucagcagcuacgccaugagcuggaucagacaggcccccggcaagggccuggaguggguggccagcaucagccacgacggcaccaagaaguaccacgccgagagcguguggggcagauucaccaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32490 - RNA, 432 nt, Artificial Sequence
  derived and/or modified sequence opt4 from anti-HIV_cap256-119-044746_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgugaucagcuacgacggcagcaacaaguacuacgccgacagcgugaagggcagauucaccaucagcagagacaacagcaagaacaccguguaccuggagaugaacagccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32491 - RNA, 432 nt, Artificial Sequence
  derived and/or modified sequence opt4 from anti-HIV_cap256-119-044740_VR-Chain
cagaugcaccugguggagagcggcggcggcguggugcagcccggcaugagccugagacugagcugcgccgccagccaguucaacuucggcagcuucggcaugcacugggugagacaggcccccggcaagggccuggaguggguggccaccaucagcuacgacggcaccaagaaguaccacagcgacagcguguggggcagacugagcaucagcagagacaacagcaagaacacccuguuccugcagaugaacagccugagaaccgaggacaccgcccuguacuucugcgugagagaccagagagaggacgacugcgaggagugguggagcgacuacuacgacuucggcaagaagcugcccugcagaaagagcagaggccuggccggcaucuucgacaucuggggccacggcaccauggugaccgugagcagc

SEQ ID NO: 32492 - RNA, 432 nt, Artificial Sequence
  derived and/or modified sequence opt4 from anti-HIV_cap256-119-043790_VR-Chain
cugcugcagcugguggagagcggcggcggcguggugcagcccggcaacagccugagacugagcugcgccgccgccggcuucaccuucagcgacuacagccugcacugggugagacaggcccccggcaagggccuggaguggguggccaugaucagcgacgacggcaaccuggacuucuacgccgccagcgugaagggcagauucaccaucagcagagacaacagcaucaacaccguguaccugcagaugaacagccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggagccagggcaccauggugaccgugagcagc

SEQ ID NO: 32493 - RNA, 432 nt, Artificial Sequence
  derived and/or modified sequence opt4 from anti-HIV_cap256-119-042880_VR-Chain
gaggugagacugguggagagcggcggcggccuggugcagcccggcggcagccugagacugagcugcgccgccagcggcuucacccugagcgacuacuacaugagcuggaucagacaggcccccggcaagggccuggaguggguggccgccaucagcuucgccggcaccaagaagcacuacggcaacagcgugaagggcagauucaccaucagcagagacaacagcaagaacacccuguaccuggagaugaacagccugagaguggaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32494 - RNA, 432 nt, Artificial Sequence
  derived and/or modified sequence opt4 from anti-HIV_cap256-119-042606_VR-Chain
cagaugcagcugguggagagcggcggcggcguggugcagcccggcagaagccugagacugagcugcgccgccagccaguucaccuucggcagcuacggcaugcacugggugagacagauccccggcaagggccuggagugggugaccggcaucagcuucgccgccaccaagaccuacuacggcgacagcgugagaggcagauucaccgugagcagagacaucagcaagaacacccuguaccugcagaugaacagccugagacccgaggacaccgccauguacuacugcgccagagaccagagauacuacgagugcgaggagugggccagcgacuacuacgacuucggcagagagcagcccugccaggaccccagaggcguggugggcauccuggaccuguggggccagggcaccauggugaccgugagcagc

SEQ ID NO: 32495 - RNA, 432 nt, Artificial Sequence
  derived and/or modified sequence opt4 from anti-HIV_cap256-119-042444_VR-Chain
caggugcagcugguggagagcggcggcgacguggugcaccccggcggcagccugagacugagcugcgccgccagcggcuucaccuucagcagcuacggcauccacugggugagacaggcccccggcaagggccuggaguggguggccgccaucagcuacgacggcagcgacaaguaccacaccaacagcguguggggcagauucaccgugagcagagacaacagcaagaacaccguguaccugcagaugaacagccugagagccgaggacaccgcccuguacuucugcgugagagacagaagagagagcgagugcgagcugugggagagcgacuacuacgacuucggcaagagacugcccugcgugaagcccagaggcguggccggcguguucgacaucuggggccagggcaccauggugaccgugagcagc

SEQ ID NO: 32496 - RNA, 432 nt, Artificial Sequence
  derived and/or modified sequence opt4 from anti-HIV_cap256-119-040328_VR-Chain
caggugcagcugguggagagcggcggcggcguggugcagcccggcggcagccugagacugagcugcgccgccagcggcuucaccuucagcagcuacagcaugaacugggugagacaggcccccggcaagggccuggaguggguggccagcaucagcuucgccggcaccaagcagcacuacggcaacagcgugaagggcagauucaccaucagcagagacaacagcaagaacaccguguaccugcagaugaacagccugagacuggaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32497 - RNA, 432 nt, Artificial Sequence
  derived and/or modified sequence opt4 from anti-HIV_cap256-119-040164_VR-Chain
cagaugcaccugguggagagcggcggcggcguggugcagcccggcaugagccugagacugagcugcgccgccagccaguucaacuucggcagcuucggcaugcacugggugagacaggcccccggcaagggccuggaguggguggccaccaucagcuacgacggcaccaagaaguaccacagcgacagcguguggggcagauucagcaucagcagagacaacagcaagaacacccuguaccugcagaugaacagccugagaaccgaggacaccgcccuguacuucugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32498 - RNA, 432 nt, Artificial Sequence
  derived and/or modified sequence opt4 from anti-HIV_cap256-119-039130_VR-Chain
gaggagcagcugguggagagcggcggcggccuggugcagcccggcagaagccugagacugagcugcaccggcagcggcuucagauucggcgacuacgccaugaacugggugagacaggcccccggcaagggccuggagugggugaccuucaucagcuacgacggcagcaacaagcacuacgccgacagcgugaagggcagauucaccgugagcagagacaacagcaagaacacccugcaccugcagaugaacagccugagacccgaggacaccgcccuguacuucugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32499 - RNA, 432 nt, Artificial Sequence
  derived and/or modified sequence opt4 from anti-HIV_cap256-119-038138_VR-Chain
caggugcagcugguggagagcggcggcggcguggugcagaccggcagaagccugagacugagcugcaccggcagccaguucaccuucggcagauacggcauguacugggugagacaggcccccggcaagggccuggaguggguggccagcaucagcuacgacggcagagacuucuaccacgccagaagcguguggggcagauucaccaucagcagagacaacagcaagaacacccugcaccugcagaugaacagccugagacccgaggacaccgcccuguacuucugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32500 - RNA, 432 nt, Artificial Sequence
  derived and/or modified sequence opt4 from anti-HIV_cap256-119-037868_VR-Chain
caggugcagcugguggagagcggcggcggcguggugcagcccggcagaagccugagacugagcugcgccgccagccaguucaccuucagcaaguacggcaugcacugggugagacaggcccccggcaagggccugcaguggguggccggcaucagcuacgacggcagcgacaaguaccacgcccacuucguguggggcagauucagcaucagcagagacaacagcaagaacgcccuguaccugcagaugaacagccugagaaccgaggacaccgcccuguacuucugcgugagagaccugagagagagcgagugcgaggaguggaagagcgacuacuacgacuucggcagaaagggccccugccugaagcccagaggcguggccggcagcuucgacaucuggggccagggcaccguggugaccgugagcagc

SEQ ID NO: 32501 - RNA, 432 nt, Artificial Sequence
  derived and/or modified sequence opt4 from anti-HIV_cap256-119-037102_VR-Chain
caggugaagcugguggagagcggcggcggcguggugcagcccggcaagagccugagacugagcugcaccgccagccaguucaccuucagcaacuucggcaugcacugggugagacaggcccccggcaagggccuggaguggguggccagcaucagcuucgugggcaucaagaagcacuacgccaacuucgugagaggcagauucaccaucagcagagaccagagcaagaacacccuguaccugcagaugaacagcgugagaguggaggacaccgccagauacuacugcgccagagacaugagagaguacgagugcgagcugugggccagcgacuacuacgacuucggcaagccccagcccugcgaggaccccagaggcguggugggcaccuucgacauguggggccugggcacccuggugaccgugagcagc

SEQ ID NO: 32502 - RNA, 438 nt, Artificial Sequence
  derived and/or modified sequence opt4 from anti-HIV_cap256-119-036683_VR-Chain
ggcgugcagcugguggagagcggcggcgccguggugagacccggcggcagccugacccugagcugcgccgccagccaguucauccugagcagcuacggcaugcacugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32503 - RNA, 432 nt, Artificial Sequence
  derived and/or modified sequence opt4 from anti-HIV_cap256-119-036495_VR-Chain
caggugcagcugguggagagcggcggcggcguggugcagcccggcagaagccugagacugagcugcgccgccagcggcuucagcuucagcagcuacggcaugcacugggugagacaggcccccggcaagggccuggaguggguggccagcaucagcuucgugggcaucaagacccacuacgccaacagcgugagaggcagauucaccaucagcagagaccagagcaagaacacccuguaccugcagaugaacagcgugagaaucgaggacaccgccagauacuucugcgccagagacaugagagaguacgagugcgagcugugggccagcgacuacuacgacuucggcaagccccagcccugcgaggaccccagaggcguggugggcaccuucgacauguggggccugggcacccuggugaccgugagcagc

SEQ ID NO: 32504 - RNA, 438 nt, Artificial Sequence
  derived and/or modified sequence opt4 from anti-HIV_cap256-119-035375_VR-Chain
gaggugcagcugguggagagcggcggcggccuggugcagcccggcagaagccugagacugagcugcgccgccagcggcuucacccuggaggacuacggcaugcacugggugagacaggcccccggcaagggccuggaguggguggccagcaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32505 - RNA, 438 nt, Artificial Sequence
  derived and/or modified sequence opt4 from anti-HIV_cap256-119-035165_VR-Chain
caggugcaccugguggagagcggcggcggcgugggccagcccgccagaagccugagacugagcugcgccgccagcggcuucauccugagcagcuacggccugcacugggugagacaggcccccggcaagggccuggaguggguggcccugaucagcuacgacggcaacaacgaguacuacgccgagagcguguggggcagauucaccaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32506 - RNA, 432 nt, Artificial Sequence
  derived and/or modified sequence opt4 from anti-HIV_cap256-119-035109_VR-Chain
caggugcagcugguggagagcggcggcggcguggugcagcccggcagaagccugagacugagcugcgccaccgccggcuucaccuucagcagcuacgccaugcacugggugagacaggcccccggcaagggccuggaguggguggccagcaucagcuacgacggcagcgacaaguaccacgccgaccugguguggggcagauucaccaucagcagagacaacagcaagaacacccuguaccugcagaugaacagccugagagccgaggacaccgcccuguacuacugcgugagagacgccagagagagcgagugcgagcugugggagagcgacuacuacaacuucggcagaaagcugcccugcgugaagcccagaggcguggccggcacccuggacaucuggggccagggcaccauggugaccgugagcagc

SEQ ID NO: 32507 - RNA, 339 nt, Artificial Sequence
  derived and/or modified sequence opt4 from anti-HIV_cap256-119-033789_VR-Chain
cagguguaccugguggagagcggcggcggcguggugcagcccggcagaagccugagacugagcugcgccgccagccacuucagccugagcagcuacggcaugcacugggugagacaggcccccgacaucagcaagaacacccuguaccugcaggugaacagccugagacccgaggacaccgccauguacuacugcgccagagaccagagauacuacgagugcgaggagugggccagcgacuacuacgacuucggcaaggagcagcccugccuggaccccagaggcguggugggcaucuucgacaucuggggccagggcaccauggugaccgugagcagc

SEQ ID NO: 32508 - RNA, 432 nt, Artificial Sequence
  derived and/or modified sequence opt4 from anti-HIV_cap256-119-033641_VR-Chain
caggugcagcugguggagagcggcggcggcguggugcagaccggcagaagccugagacugagcugcaccggcagccaguucaccuucggcagauacggcauguacugggugagacaggcccccggcaagggccuggaguggguggccgccaucagcuacgacggcagcgacaaguaccacaccaacagcguguggggcagauucaccgugagcagagacaacagcaagaacaccguguaccugcagaugaacagccugagagccgaggacaccgcccuguacuucugcgugagagacagaagagagagcgagugcgagcugugggagagcgacuacuacgacuucggcaagagacugcccugcgugaagcccagaggcguggccggcguguucgacaucuggggccagggcaccauggugaccgugagcagc

SEQ ID NO: 32509 - RNA, 432 nt, Artificial Sequence
  derived and/or modified sequence opt4 from anti-HIV_cap256-119-032113_VR-Chain
caggugcagcugguggagagcggcggcggcguggugcagcccggcagaccccugagacugagcugcgugggcagcggcuucagcuucaucaccagcgccaugcacugggugagacaggcccccgacaagggccuggaguggguggccaucaucagcgacggcggcaacaacagacacuacgccgacagcgugaagggcagauucaccaucagcagagacaacagcaagaacaccguguuccuggaggugaacaaccugagacccgaggacaccgccauguacuacugcgccagagaccagagauacuacgagugcgaggagugggccagcgacuacuacgacuucggcagagagcagcccugccaggaccccagaggcguggugggcguguucgacauguggggccagggcaccauggugaccgugagcagc

SEQ ID NO: 32510 - RNA, 432 nt, Artificial Sequence
  derived and/or modified sequence opt4 from anti-HIV_cap256-119-031739_VR-Chain
caggugcagcugguggagagcggcggcggcguggugcagcccggcagaagccugagaaucagcugcgccgccagccaguucaccuucaacagauacggcaugcacugggugagacaggcccccggcaagggccuggaguggguggccagcaucagcuacgacggcagcgacaaguaccacgccggccugguguggggcagauucaucaucagcagagacaacagcaagaacacccuguaccugcagaugaacagccugagagccgaggacaccgcccuguacuacugcgugagagacgagagagagagcgagugcgagcugugggagagcgacuacuacgacuucggcaagaagcugcccugcgugaagcccagaggcguggccggcacccuggacaucuggggccagggcaccagagugaccgugagcagc

SEQ ID NO: 32511 - RNA, 432 nt, Artificial Sequence
  derived and/or modified sequence opt4 from anti-HIV_cap256-119-030932_VR-Chain
gaggugcagcugcuggagagcggcggcggcguggugcagcccggcagaagccugagacugagcugcgccgccagcggcuucgccuucagccacuacggcaucuucugggugagacaggcccccggcaagggccuggagugggugaccgugaucagcggcgacggcagcacccagugguacgccgacagcgugcagggcagauucaccaucagcagagacagcagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32512 - RNA, 438 nt, Artificial Sequence
  derived and/or modified sequence opt4 from anti-HIV_cap256-119-030740_VR-Chain
caggugcagcugguggaguucggcggcggcguggugcagaccggcagaagccugagacugagcugcgccgccagcggcuucaccuucagcgacuacggcaugcacugggugagacaggcccccggcaagggccuggaguggguggccagcaucagcaacgacggcagcaagaaguaccacggcgacagcgugugggccagauucaucaucagcagagacaacagcaagaacacccuguuccugcagaugagcagccugagagccgaggacaccgcccuguacuucugcgugagagaccacagagaggacgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32513 - RNA, 438 nt, Artificial Sequence
  derived and/or modified sequence opt4 from anti-HIV_cap256-119-030197_VR-Chain
caggugcaccugguggagagcggcggcggcguggugcagcccggcaagagccugagacugagcugcgccgccagccaguucaccuucugcagauacggcaugcacugggugagacaggcccccggcaagggccuggaguggguggccagcaucagcaacgacggcaccgacaaguaccacgccgacaacguguggggcagauucaccaucagcagagacaacagcaagaacacccuguaccuggagaugaacagccugagaggcgaggacaccgcccuguacuacugcgccaaggacaugagagaggacgagugcgaggagugguggagcgacuacuacgacuucggcaaggagcugcccugcagaaaguggaagaccagaggcguggccggcauccuggacaacuggggccagggcaccauggugaccgugagcagc

SEQ ID NO: 32514 - RNA, 438 nt, Artificial Sequence
  derived and/or modified sequence opt4 from anti-HIV_cap256-119-027047_VR-Chain
cagaugcagcugguggagagcggcggcggcguggugcagcccggcagaagccugacccugagcugcgccgccagccaguucaccuucagaaacuacggcaugcacugggugagacaggcccccggcaagggccuggaguggguggccagcaucagcaaggacggcaccaagaaguaccacggcgacagcguguggggcagauucaucaucagcagagacaacagcaagaacacccuguuccugcagaugagcagccugagagccgaggacaccgcccuguacuucugcgugagagaccagagagaggccgagugcgaggagugguggagcgacuacuacgacuucggcagagagcugcccugcagaaaguucagaggccugggccuggccggcaucuucgacaucuggggccacggcaccauggugaccgugagcagc

SEQ ID NO: 32515 - RNA, 432 nt, Artificial Sequence
  derived and/or modified sequence opt4 from anti-HIV_cap256-119-026950_VR-Chain
caggugcagcugguggagagcggcggcggcguggugcagcccggcaagagccugagaaucagcugcgccgccagcagauucaccuucggcagauucggcaugcacugggugagacaggcccccggcaagggccuggaguggguggccagcaucagcuacgacggcagcgacaaguaccacgccggccugguguggggcagauucaucaucagcagagacaacagcaagaacacccuguaccugcagaugaacagccugagagccgaggacaccgcccuguacuacugcgugagagacgagagagagagcgagugcgagcugugggagagcgacuacuacaacuucggcaagaacuaccccugcgugaagcccagaggcguggccggcacccuggacaucuggggccagggcaccaccgugaucgugagcagc

SEQ ID NO: 32516 - RNA, 438 nt, Artificial Sequence
  derived and/or modified sequence opt4 from anti-HIV_cap256-119-026279_VR-Chain
cagaugcagcugguggagagcggcggcggcguggugcagcccggcaccagccugacccugagcugcgccgccagccaguucagcuucaccagcuacggcaugcacugggugagacaggcccccggcaagggccuggaguggguggccagcaucagcaacgacggcaccaagaaguaccacgccgagagcguguggggcagauucaccaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacaucuggggccacggcaccguggugaucgugagcagc

SEQ ID NO: 32517 - RNA, 432 nt, Artificial Sequence
  derived and/or modified sequence opt4 from anti-HIV_cap256-119-025355_VR-Chain
gaggugcagcugguggagagcggcggcggccuggugcagcccggcagaagccugagacugagcugcgccgccagcggcuucagcuucagcgacuacgccaugcacugggugagacaggcccccggccagggccuggaguggguggccuucaucagcuacgacggcaccaagaaguaccacagcgacagcguguggggcagacugaccaucagcagagacaacagcagaaacacccuguuccugcagaugaacagccugagaaccgaggacaccgcccuguacuucugcgugagagaccagagagaggacgacugcgaggagugguggagcgacuacuacgacuucggcaagaagcugcccugcagaaagagcagaggccuggccggcaucuucgacaucuggggccacggcaccauggugaccgugagcagc

SEQ ID NO: 32518 - RNA, 432 nt, Artificial Sequence
  derived and/or modified sequence opt4 from anti-HIV_cap256-119-025301_VR-Chain
caggugcaccugguggccagcggcggcggcguggugccccccggcagaagccugagacugagcugcguggccagccaguucaccuucagcggcuucggccuguacugggugagacaggcccccggcaagggccuggaguggguggccgccaucagcuucgccggcaccaagaagcacuacgccaacagcgugaagggcagauucaccaucagcagagacaacagcaagaacacccuguaccugcagaugaacagccugagacccgacgacaccgcccuguacuacugcgccaaggaccugagagaguacgagugcgaggaguggaccagcgacuacuacgacuucggcagaccccagcccugcaucgacagcagaggcguggugggcauccuggacaucuggagccagggcaccauggugaccgugagcagc

SEQ ID NO: 32519 - RNA, 438 nt, Artificial Sequence
  derived and/or modified sequence opt4 from anti-HIV_cap256-119-025010_VR-Chain
caggugcagcugguggagagcggcggcggcguggugcagcccggcagaagccugagacugagcugccccgccagcggcuucagcuucagcaccuacggcaugcacugggugagacaggcccccggcaagggccuggaguggguggccagcaucagcaacgacggcaacaagaaguaccacggcgagagcgugugggacagauucaccaucagcagagacaacagcaagaacacccuguuccugcagaugaacagacugagaguggaggacaccgcccuguacuucugcgugaaggaccagagagaggacgagugcgaggagugguggagcgacuacuacgacuucggcagagagcugcccugcagaaaguucagaggccugggccuggccggcaucuucgacguguggggccacggcaccauggugaccgugagcagc

SEQ ID NO: 32520 - RNA, 432 nt, Artificial Sequence
  derived and/or modified sequence opt4 from anti-HIV_cap256-119-024631_VR-Chain
caggugcagcugauggagagcggcggcggcguggugcagcccggcggcagccugagacugagcugcgccgccagcggcuucaccuucagcagcuacggcaugcacugggugagacaggcccccggcaagggccuggaguggguggccggcaucagcuacgacggcagcgacaaguaccacgcccacuucguguggggcagauucaucaucagcagagacaacagcaagaacgcccuguaccugcagaugaacagccugagacccgaggacaccgcccuguacuucugcgugagagaccugagagagagcgagugcgaggaguggcagagcuacuacuacgacuucggcagaaagggccccugccugaagcccagaggcguggccggcagcuucgacaucuggggccagggcaccguggugaccgugagcagc

SEQ ID NO: 32521 - RNA, 432 nt, Artificial Sequence
  derived and/or modified sequence opt4 from anti-HIV_cap256-119-024467_VR-Chain
gaggugcagcugguggagagcggcggcggccuggugcagcccggcggcagccugaacgugagcugcgccgccagcggcuucaccuucagaaccuacgccaugcacugggugagacaggcccccggcaagggccuggaguggguggccgccaucagcuacgacggcgacaacaaguacagcgccgacagcgugaagggcagauucaccaucagcagagaccagagcaagaacacccuguaccugcagaugaacagcgugagaguggaggacaccgccagauacuacugcgccagagacaugagagaguacgagugcgagcugugggccagcgacuacuacgacuucggcaagccccagcccugcgaggaccccagaggcguggugggcaccuucgacauguggggccugggcacccuggugaccgugagcagc

SEQ ID NO: 32522 - RNA, 432 nt, Artificial Sequence
  derived and/or modified sequence opt4 from anti-HIV_cap256-119-023805_VR-Chain
caggugcagcugguggagagcggcggcggcguggugcagcccggcaagagccugagacugagcugcgccgccagccaguucggcuucggcagcuacggcaugcacugggugagacaggcccccggcaagggccuggaguggguggccaccaucagcuucgacggcgccgacaaguaccacgccgacgacguguggggcagauucagcaucagcagagacaacagcaagaacacccuguaccugcagaugaacaaccugagacccgaggacaccgcccuguacuacugcgccaaggaccugagagaggacgagugcgaggagagauggagcgacuacuacgacuucggcaagcagcugcccugcagaaagagcagaggcguggccggcguguucgacaacuggggccagggcaccauggugaccgugagcagc

SEQ ID NO: 32523 - RNA, 432 nt, Artificial Sequence
  derived and/or modified sequence opt4 from anti-HIV_cap256-119-021736_VR-Chain
caggugcagcugguggagagcggcggcggcguggugcagcccggcagaagcgugagacugagcugcguggccagccaguucagcuucgacagauacggcaugcacugggugagacaggcccccggcaagggccuggaguggguggccagcaucagcuacgacggcaccgacaaguaccacgccgacaagguguggggcagauucaccaucagcagagacaacagcaagaagacccuguaccugcagaugaacagccugagacccgaggacgccgcccuguacuacugcgccaaggaccugagagaggacgagugcgaggagugguggagcgacuacuacgacuucggcaagcagcugcccugcagaaagagcagaggcguggccggcaucuucgacagcuggggccagggcaccauggugaccgugagcagc

SEQ ID NO: 32524 - RNA, 438 nt, Artificial Sequence
  derived and/or modified sequence opt4 from anti-HIV_cap256-119-021203_VR-Chain
cagaugcagcugguggagagcggcggcggcguggugcagcccggcagaagccugacccugagcugcgccgccagccaguucaccuucagcaacuacggcaugcacugggugagacaggcccccggcaagggccuggaguggguggccagcgugagcaacgacggcaccaagaaguaccacggcgacagcgugugggacagauucaccaucagcagagacaacagcaagaacacccuguuccugcagaugagcagccugagagccgaggacaccgccguguacuucugcgugagagacgagagagaggacgagugcgaggagugguggagcgacuacuacgacuucggcagagagcugcccugcagaaaguucagaggccugggccuggccggcaucuucgacaucuggggccacggcacccuggugaccgugagcagc

SEQ ID NO: 32525 - RNA, 432 nt, Artificial Sequence
  derived and/or modified sequence opt4 from anti-HIV_cap256-119-020569_VR-Chain
caggugcagcugguggagagcggcggcggcguggugcagcccggcgagagccugagaaucagcugcgccgccagccaguucaccuucagcagauacggcaugcacugggugagacaggcccccggcaagggccuggaguggguggccagcaucagcuucgacggcagagacaaguaccacagcagccugguguggggcagacugaccaucagcagagacaacagcaagagcacccuguuccugcagaugaacagccugagacccgaggacaccgcccuguacuacugcgccagagacgugagagagagcgagugcgaggaguggcagagcgacuacuacgccuucuacagaaagcugcccugcgugaagcccagaggcguggccggcacccuggacaucuggggccagggcaccauggugaccgugagcagc

SEQ ID NO: 32526 - RNA, 432 nt, Artificial Sequence
  derived and/or modified sequence opt4 from anti-HIV_cap256-119-019432_VR-Chain
caggugcagcuggugcagagcggcggcggcguggugcagcccggcagaagccugagaaucagcugcgccgcccccuacuucaccuucggcagauacggcuuccacugggugagacaggcccccggcaagggccuggaguggguggccagcaucagcuucgacggcagagacuacuaccacagcccccacguguggggcagacugaccaucagcagagacaacagcaagaacacccuguaccugcagaugaacagccugagagccgaggacaccgcccuguacuacugcgccagagaccugagagagagcgagugcgaggagugggagagcgacuacuacgacuucggcaagaagggccccugcgugaagcccagaggcguggccggcagccuggacauguggggccagggcaccauggugaccgugagcagc

SEQ ID NO: 32527 - RNA, 432 nt, Artificial Sequence
  derived and/or modified sequence opt4 from anti-HIV_cap256-119-018827_VR-Chain
caggcccagcugguggagagcggcggcggcguggugcagcccggcagaagccugagacugagcugcgccgccagccacuucagcuucaacagauacggcaugcacugggugagacaggcccccggcaagggccuggaguggguggccggcaucagcuacgacggcagagacuucuaccacgccgacaucguguggggcagacugaccaucagcagagacaacagcaagaacaccguguaccugcagaugaacagccugagagccgacgacaccggccuguacuacugcgccagagacgugagagagagcgagugcgaggagugggagagcuacuacuacgacuucggcagaaagggccccugccugaagcccagaggcguggccggcaccuucgacauguggggccagggcaccaucgugagcgugagcgcc

SEQ ID NO: 32528 - RNA, 432 nt, Artificial Sequence
  derived and/or modified sequence opt4 from anti-HIV_cap256-119-018483_VR-Chain
cuggugcagcugguggagagcggcggcggcguggugcagcccggcaagagccugagacugagcugcguggccagccaguucaccuucaacagauacggcaugcacugggugagacaggcccccggcaagggccuggaguggguggccggcaucagcuacgacggcagagacaaguaccacgcccacuucguguggggcagaaucaccaucagcagagacaacagcaagaacacccuguaccugcagaugaacagccugagagccgaggacaccgcccuguaccacugcgugagagaccugagagagagcgagugcgagcugugggagagcgacuacuacgacuucggcaagaagcugcccugcgugaagcccagaggcguggccggcaucuucgaccuguggggccagggcaccauggugaccgugagcagc

SEQ ID NO: 32529 - RNA, 432 nt, Artificial Sequence
  derived and/or modified sequence opt4 from anti-HIV_cap256-119-018118_VR-Chain
caggugcaccugguggccagcggcggcggcguggugccccccggcagaagccugacccugagcugcguggccagccaguucaccuucagcggcugcggccugcacugggugagacaggcccccggcaagggccuggaguggguggccagcaucagcuucgccggcaccaagaagcacuacggcaacagcgugaagggcagauucaccaucagcagagacaacagcaagaacacccuguaccugcagaugaacagccugagacccgaggacaccgcccuguacuacugcgccaaggaccugagagaguacgagugcgaggaguggaccagcgacuacuacgacuucggcagagaccagcccugcaucgacagcagaggcguggugggcauccuggacaucuggggccagggcaccauggugaccgugagcagc

SEQ ID NO: 32530 - RNA, 432 nt, Artificial Sequence
  derived and/or modified sequence opt4 from anti-HIV_cap256-119-017782_VR-Chain
caggugcagcugguggagagcggcggcggcguggugcagcccggcaagagccugagacugagcugcgccgccagcggcuuccccuucagcaacuacgccaugcacugggugagacagacccccggcagaggccuggaguggguggccggcaucagcuucgccgccaccaagaaguacuacagacccagcgugagaggcagauucaccgugagcaccgacaucagcaagaacacccuguaccuggagaugaacagccugagacccgaggacaccgcccuguacuucugcgccagagaccagagauacuacgagugcgaggagugggccagcgacuacuacgacuucggcagagagcagcccugccuggaccccagaggcguggugggcaucuucgaccuguggggccagggcaccauggugaccgugagcagc

SEQ ID NO: 32531 - RNA, 432 nt, Artificial Sequence
  derived and/or modified sequence opt4 from anti-HIV_cap256-119-017669_VR-Chain
caggugcagcugguggagagcggcggcggcguggugcagcccggcagcagccugagacugagcugcgccgccagccacuucgccuucaacagauacggcaugcacugggugagacaggcccccggcaagggccuggaguggguggccggcaucagcuucgacggcgccgacaaguuccacgccgacaagguguggggcagauucaccaucagcagagacaacagcaagaacacccugagccugcagaugaacagccugagacccgaggacaccgcccuguacuacugcgccaaggaccugagagaggacgagugcgaggagugguggagcgacuacuacgacuucggcagaagacugcccugcagaaagagcagaggcgugagcggcaucuucgacaacuggggccagggcaccauggugaccgugagcagc

SEQ ID NO: 32532 - RNA, 432 nt, Artificial Sequence
  derived and/or modified sequence opt4 from anti-HIV_cap256-119-016976_VR-Chain
caggugcagcugguggagagcggcggcggcguggugcagcccggcagaagccugagacugagcugcgccgccagccaguucagcuucggcgacuucggcaugcacugggugagacaggcccccggcaagggccuggaguggguggccgccaucagcuucgccggcaccaagaagaacuacgccgacagcgugagaggcagauucaccaucagcagagacagcagcaagaacacccuguaccugcagaugaacagccugagacccgaggacaccgcccuguacuacugcgugaaggacaugagaggcuacgagugcgaggaguggaccagcgacuacuacgacuucggcagaccccagcccugcaucgacagcagaggcguggugggcaccuucgacguguggggccagggcaccauggugaccgugagcagc

SEQ ID NO: 32533 - RNA, 432 nt, Artificial Sequence
  derived and/or modified sequence opt4 from anti-HIV_cap256-119-015432_VR-Chain
gaggugcagcugcuggagagcggcggcggccuggugcagcccggcggcagccugagacugagcugcgccgccagcggcuucaccuucagcggcuacagccugaacugggugagacaggcccccggcaagggccuggaguggguggccagcaucagcuacgacggcagcgacaaguaccacgccgacagaguguggggcagauucaccaucagcagagacaacagcaagaacacccuguaccugcagaugaacagccugagagccgaggacaccgcccuguacuacugcgugagagacgccagagagagcgagugcgagcugugggagagcgacuacuacaacuucggcagaaagcugcccugcgugaagcccagaggcguggccggcacccuggacaucuggggccagggcaccauggugaccgugagcagc

SEQ ID NO: 32534 - RNA, 432 nt, Artificial Sequence
  derived and/or modified sequence opt4 from anti-HIV_cap256-119-015281_VR-Chain
cugggcagacugguggccagcggcggcggcguggugccccccggcagaagccugagacugagcugcguggccagccaguucaccuucagcggcugcggccugcacugggugagacaggcccccggcaagggccuggaguggguggccagcaucagcuucgccggcaccaagaagcacuacggcaacagcgugaagggcagauucaccaucagcagagacaacagcaagaacaccguguaccuggagaugaacagccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggggccagggcaccauggugaccgugagcagc

SEQ ID NO: 32535 - RNA, 432 nt, Artificial Sequence
  derived and/or modified sequence opt4 from anti-HIV_cap256-119-014957_VR-Chain
caggugcaggugguggagagcggcggcggcguggugcagcccggcaccagccugagacugagcugcaccgugagcggcuucagcuucagcaacuacgaccugcacugggugagacagacccccgccaagggccuggaguggguggccguggugagcuacgacggcagcagagaguacuacaccgacagcgugaagggcagauucaucaucagcagagaccagagcaagaacacccuguaccugcagaugaacagcgugagacuggaggacaccgccagauacuacugcgccagagacaugagagaguacgagugcgagcugugggccagcgacuacuacgacuucggcaagccccagcccugcgaggaccccagaggcguggugggcaccuucgacauguggggccugggcacccuggugaccgugagcagc

SEQ ID NO: 32536 - RNA, 432 nt, Artificial Sequence
  derived and/or modified sequence opt4 from anti-HIV_cap256-119-014777_VR-Chain
caggugcaccugguggagagcggcggcggcguggugcagcccggcagaagccugagacugagcugcgccgccagccacuucagccugagcagcuacggcaugcacugggugagacaggcccccggcaagggccuggaguggguggccggcaucagcuucgccgccaccaagaccuacuacggcggcagcgugaagggcagauucaccgugagcagagacaucagcaagaacacccuguaccugcagaugaacagccugagacccgaggacaccgccauguacuacugcgccagagaccagagauacuacgagugcgaggagugggccagcgacuacuacgacuucggcagagagcagcccugccaggaccccagaggcguggugggcguguucgacauguggggccagggcaccauggugaccgugagcagc

SEQ ID NO: 32537 - RNA, 432 nt, Artificial Sequence
  derived and/or modified sequence opt4 from anti-HIV_cap256-119-014313_VR-Chain
caggugcagcugguggagagcggcggcggcguggugcagcccggcagaagccugagaaucagcugcgccgccagccaguucaccuucagcagauacggcaugcacugggugagacaggcccccggcaagggccuggaguggguggccagcaucagcuacgacggcagagacuaccaccacgccggcgccguguggggcagauucaucaucagcagagacaacagcaagaacagccugcaccugcagaugaacagccugagacccgaggacaccgcccuguacuucugcgccagagaccugagagagagcgagugcgaggagugggagagcgacuacuacaacuucuggaagaagcugcccugcgugaagcccagaggcguggugggcauccuggacaucuggggccagggcaccguggugaccgugagcagc

SEQ ID NO: 32538 - RNA, 438 nt, Artificial Sequence
  derived and/or modified sequence opt4 from anti-HIV_cap256-119-014219_VR-Chain
cagaugcagcugguggagagcggcggcggcguggugcagcccggcagcagccugacccugagcugcgccgccagccaguucaccuucagcaacuacggcaugcacugggugagacaggcccccggcaagggccuggaguggguggccagcaucagcaacgacggcaccaagaaguaccacggcgacagcgugugggacagauucaccaucagcagagacaacagcaagaacacccuguuccugcagaugaacagccugagagccgaggacaccgcccuguacuucugcgugaaggaccagagagaggacgagugcgaggagugguggagcgacuacuacgacuucggcagagagcugcccugcagaaaguucagaggccugggccuggccggcaccuucgacaucuggggccacggcaccaugcugaucgugagcagc

SEQ ID NO: 32539 - RNA, 432 nt, Artificial Sequence
  derived and/or modified sequence opt4 from anti-HIV_cap256-119-013631_VR-Chain
caggugcagcugguggagagcggcggcggcguggugcagcccggcagaagccugagacugagcugcgccgccagccaguucaccuucggcagcuacggcaugcacugggugagacagauccccggcaagggccuggaguggguggccaccaucagcuacgacggcaccaagaaguaccacgccgacagcgugugggacagauucaucaucagcagagacaacagcaagaacacccuguuccugcagaugaacagccugagacccgaggacaccgcccuguacuucugcgugaaggaccagagacaggacgagugcgaggagugguggagcgacuacuacgacuucggcagaagacugcccugcagaaagagcagaggccuggccggcaucuucgacguguggggccacggcaccauggugaccgugagcagc

SEQ ID NO: 32540 - RNA, 432 nt, Artificial Sequence
  derived and/or modified sequence opt4 from anti-HIV_cap256-119-012924_VR-Chain
caggugacccugguggagagcggcggcggcuucgugcagcccggcggcagccugagacugagcugcgccaccagcggcuucaccuucagcagcuacgccaugcacugggugagacaggcccccggcaagggccuggaguggguggccgccaucagcuucgacggcgccgacaaguaccacgccgacaacguguggggcagacugagcaucagcagagacaacagcaagagcacccuguaccugcagaugaacagccugagacccgaggacaccgccguguacuucugcgccaaggaccugagagaggacgagugcgaggagagauggagcgacuacuacgacuucggcaagcagcugcccugcagaaagagcagaggcguggccggcaucuucgacaacuggggccagggcaccauggugaccgugagcgcc

SEQ ID NO: 32541 - RNA, 432 nt, Artificial Sequence
  derived and/or modified sequence opt4 from anti-HIV_cap256-119-011793_VR-Chain
caggugcagcugguggagagcggcggcggcguggugcagcccggcggcagccugagacugagcugcguggccagccaguucaccuucagcagauacggcaugcacugggugagacaggcccccggcaagggccuggaguggguggccagcaucagcuacgacggcagagacaaguaccacgccgacuucguguggggcagacugaccaucagcagagacgacagcaagaagacccuguaccugcagauggacagccugagaguggacgacaccgcccuguacuacugcgugagagacaugagagagagcgagugcgagcugugggagagcgacuacuacgacuucggcaagagacugcccugcgugaagcccagaggcguggccggcaucuucgacaucuggggccagggcaccauggugaccgugagcagc

SEQ ID NO: 32542 - RNA, 432 nt, Artificial Sequence
  derived and/or modified sequence opt4 from anti-HIV_cap256-119-011413_VR-Chain
caggugcagcugguggagagcggcggcgacguggugcagcccggcagaagccugagacugagcugcgccgccagcggcuucaccuucagcaccuacggcaugcacugggugagacaggcccccggcaagggccuggaguggguggccgccaucagcuucgccggcaccaagaagaacuacgccgacagcgugagaggcagauucaccaucagcagagacagcagcaagaacacccuguaccuggagaugaacagccugagacccgaggacaccgcccuguacuacugcgccaaggacaugagaggcuacgagugcgaggaguggaccagcgacuacuacgacuucggcagaccccagcccugcaucgacagcagaggcguggugggcaccuucgacguguggggccagggcaccauggugaccgugagcagc

SEQ ID NO: 32543 - RNA, 432 nt, Artificial Sequence
  derived and/or modified sequence opt4 from anti-HIV_cap256-119-011323_VR-Chain
caggugaagcugguggagagcggcggcggcguggugccccccggcaagagccugagacugagcugcaccgccagccaguucaccuucagcaacuucggcaugcacugggugagacaggcccccggcaagggccuggaguggguggccagcaucagcuucgugggcaucaagacccacuacgccaacagcgugagaggcagauucaccaucagcagagaccagagcaagaacacccuguaccugcagaugaacagcgugagaguggaggacaccggcagauacuacugcgccagagacaugagagaguacgagugcgagcugugggccagcgacuacuacgacuucggcaagccccagcccugcgaggaccccagaggcguggugggcaccuucgacauguggggccugggcacccuggugaccgugagcagc

SEQ ID NO: 32544 - RNA, 432 nt, Artificial Sequence
  derived and/or modified sequence opt4 from anti-HIV_cap256-119-011233_VR-Chain
caggugcaccugguggagagcggcggcggcguggugcagcccggcagaagcgugagacugagcugcgccgccagccacuucagccugagcagcuacggcaugcacugggugagacaggcccccggcaagggccuggagugggugaccggcaucagcuucgccggcaccaagaccuacuacggcgacagcgugagaggcagauucaccgugagcagagacaucagcaagaacacccuguuccugcagaugaacagccugagacccgacgacaccgccauguacuacugcgccagagaccagagauacuacgagugcgaggagugggccagcgacuacuacgacuucggcagagagcagcccugccuggaccccagaggcguggugggcaucuucgaccuguggggccagggcaccauggugaccgugagcagc

SEQ ID NO: 32545 - RNA, 432 nt, Artificial Sequence
  derived and/or modified sequence opt4 from anti-HIV_cap256-119-009038_VR-Chain
caggagcagcugguggagagcggcggcggcguggugcagcccggcagaagccugagacugagcugcguggccagcagauucaccuucagcgccuucggcaugcacugggugagacaggcccccggcaagggccuggaguggguggccagcaucagcuucgccggcaucaagaaguacuacggcgacagcgugaagggcagauucaccaucagcagagacaacagcaagaacacccuguaccugcagauggacggccugagaggcgaggacaccgcccuguacuacugcgccaaggaccugagagagcuggagugcgaggagugggccagcgacuacuacgacuucggcagaccccagcccugccuggaccccagaggcgugagcggcaucagcaacguguggggccagggcaccauggugaccgugagcagc

SEQ ID NO: 32546 - RNA, 432 nt, Artificial Sequence
  derived and/or modified sequence opt4 from anti-HIV_cap256-119-008756_VR-Chain
caggugcagcugguggagagcggcggcggcguggugcagcccggcaagagccugagacugagcugcguggugagccaguucaccuucggcagauacggcaugcacugggugagacaggcccccggcaagggccuggaguggguggccagcaucagcuacgacggcagcgacaaguaccacaccagcagccuguggggcagauucaucgugagcagagacaacagcaagaacacccuguaccugcagaugaacagccugagacccgaggacaccgcccuguacuacugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32547 - RNA, 438 nt, Artificial Sequence
  derived and/or modified sequence opt4 from anti-HIV_cap256-119-008055_VR-Chain
cagaugcagcugguggagagcggcggcggcguggugcagcccggcagaagccugacccugagcugcgccgccagccaguucagcuucgccaacuacggcaugcacugggugagacaggcccccggcaagggccuggaguggguggccagcaucagcaacgacggcaccaagaaguaccacgaggagagcguguggggcagauucaccaucagcaaggacaacagcaagaacacccuguuccugcagaugaacagccugagaaucgaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32548 - RNA, 435 nt, Artificial Sequence
  derived and/or modified sequence opt4 from anti-HIV_cap256-119-006949_VR-Chain
caggugcaccugguggagagcggcggcggcguggugcagcccggcagaagccugagacugagcugcgccgccagcggcuucagcgugagcaacaacuacaugaacugggugagacaggcccccggcgagggccuggaguggguggcccugaucagcuucgacggcagacagaaggaccuggccgacagcgugaagggcagauucgccaucagcagagacaacagcaagaacacccuguaccugcagaugaacagccugagacuggaggacaccgcccuguacuacugcgccagagaccugagagagcuggacugcgaggaguggacccuguacaacuacuacgacuucggcagcagaggccccugcguggaccccagaggcgugggcggcagcuucgacguguggggccagggcaccauggugaccgugagcagc

SEQ ID NO: 32549 - RNA, 432 nt, Artificial Sequence
  derived and/or modified sequence opt4 from anti-HIV_cap256-119-006685_VR-Chain
caggugcagcugguggagagcggcggcggcguggugcagcccggcagaagccugagagugagcugcgccgccagccacuucaccuucagcagauacggcaugcacugggugagacaggcccccggcaagggccuggaguggguggccagcaucagcuacgacggcagagacuucuaccacgccagaagcguguggggcagauucaccaucagcagagacaacagcaagaacacccugcaccugcagaugaacagccugagacccgaggacaccgcccuguacuucugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32550 - RNA, 432 nt, Artificial Sequence
  derived and/or modified sequence opt4 from anti-HIV_cap256-119-006015_VR-Chain
caggugcagcugguggagagcggcggcggcguggugcagcccggcaagagccugagacugagcugcgccgccagcagauucaccuucaacagauacggcaugcacugggugagacaggcccccggcaagggccuggaguggguggccgccaucagcuucgacggcaccgacaaguaccacagcgacgacguguggggcagauucaccaucagcagagacaacagcaagaacacccuguaccugcagaugaacagccugagacccgaggacaccgcccuguacuacugcgccaaggaccugcaggaggacgagugcgaggagugguggagcgacuacuacgacuucggcaagcagcugcccugcagaaagagcagaggcguggccggcaucuucgacgacuggggccagggcaccauggugaccgugagcagc

SEQ ID NO: 32551 - RNA, 432 nt, Artificial Sequence
  derived and/or modified sequence opt4 from anti-HIV_cap256-119-005841_VR-Chain
caggugcagcugguggagagcggcggcggcguggugcagcccggcagaagccugagacugagcugcgccgccagccaguucagcuucggcaacuucggcaugcacugggugagacaggcccccggcaagggccuggaguggguggccgccaucagcuucgccggcaccaaggagaacuacgccaacagcgugagaggcagauucaccaucagcagagacaacagcaagaacacccuguaccugcagaugaacagccugagagccgaggacaccgcccuguacuacugcaccaaggacaugagagaguacgagugcgaggaguggaccagcgacuacuacgacuucggcagaccccagcccugcaucgacagcagaggcguggugggcaccuucgacguguggggccagggcaccauggugaccgugagcagc

SEQ ID NO: 32552 - RNA, 432 nt, Artificial Sequence
  derived and/or modified sequence opt4 from anti-HIV_cap256-119-005824_VR-Chain
caggugcagcugguggagagcggcggcggcguggugcagcccggcggcagccugagacugagcugcgccgccagcggcuucaccuucagaagauacgccaugcacugggugagacaggcccccggcaagggccuggaguggguggccagcaucagcuacgacggcagcgacaaguaccacaccagcagccuguggggcagauucaucgugagcagagacaacagcaagaacacccuguaccugcagaugaacagccugagacccgaggacaccgcccuguacuacugcgugagagacagaagagagagcgagugcgaggagagauggagcgacuacuacgacuucggcaagcagcugcccugcgugaagcccagaggcguggccggcaucuucgacaucuggggccagggcaccauggugaccgugagcagc

SEQ ID NO: 32553 - RNA, 432 nt, Artificial Sequence
  derived and/or modified sequence opt4 from anti-HIV_cap256-119-005494_VR-Chain
caggugagacugguggagagcggcggcggcguggugcagcccggcagaagccugagaaucagcugcgccgccagccaguucauguucaacaaguacggcaugcacugggugagacaggcccccggcaagggccuggaguggguggccagcaucagcuacgacggcagcgacaaguaccacgccgaccugguguggggcagauucaccaucagcagagacaacagcaagaacacccuguaccugcagaugaacagccugagagccgaggacaccgcccuguacuacugcgugagagacgccagagagagcgagugcgagcugugggagagcgacuacuacaacuucggcagaaagcugcccugcgugaagcccagaggcguggccggcacccuggacaucuggggccagggcaccauggugaccgugagcagc

SEQ ID NO: 32554 - RNA, 432 nt, Artificial Sequence
  derived and/or modified sequence opt4 from anti-HIV_cap256-119-004949_VR-Chain
caggugcagcugguggagagcggcggcggcguggugcagcccggcagaagccugagacugagcugcgccgccagcaaguucagccugagcagcuacggcaugcacugggugagacaggcccccggcagaggccuggaguggguggccggcaucagcuucgccgccaccaagaaguacuacagacccagcgugagaggcagauucaccgugagcaccgacaucagcaagaacacccuguaccuggagaugaacagccugagacccgaggacaccgcccuguacuucugcgccagagaccagagauacuacgagugcgaggagugggccagcgacuacuacgacuucggcagagagcagcccugccuggaccccagaggcguggugggcaucuucgaccuguggggccagggcaccauggugaccgugagcagc

SEQ ID NO: 32555 - RNA, 432 nt, Artificial Sequence
  derived and/or modified sequence opt4 from anti-HIV_cap256-119-004422_VR-Chain
cacgugcagcugguggagagcggcggcggcguggugcagcccggcagaagccugagacugagcugcgccgccagcggccugagcuucagcagcuacgccaugcacugggugagacaggcccccggcaagggccuggaguggguggccguggugagcuacgacggcaccaccaaguucuacgccgacagcgugaagggcagauucaccaucagcagagacaacagcaagaacacccuguaccugcagaugaacagccugagaggcgaggacaccgcccuguacuacugcgccaaggaccugagagaguacgagugcgaggaguggaccagcgacuacuacgacuucggcagaccccagcccugcaucgacagcagaggcguggugggcauccuggacaucuggagccagggcaccauggugaccgugagcagc

SEQ ID NO: 32556 - RNA, 432 nt, Artificial Sequence
  derived and/or modified sequence opt4 from anti-HIV_cap256-119-003932_VR-Chain
caggugcagcugcuggagagcggcggcggcguggugcagcccggcggcagccugagacugagcugcaaggccagccacuucagcuucgacagauacggcaugcacugggugagacaggcccccggcaagggccuggaguggguggccgccaucagcuucgacggcgccgacaaguaccacgccgacaacguguggggcagacugagcaucagcagagacaacagcaagagcacccuguaccugcagaugaacagccugagacccgaggacaccgccguguacuucugcgccaaggaccugagagaggacgagugcgaggagagauggagcgacuacuacgacuucggcaagcagcugcccugcagaaagagcagaggcguggccggcaucuucgacaacuggggccagggcaccauggugaccgugagcgcc

SEQ ID NO: 32557 - RNA, 438 nt, Artificial Sequence
  derived and/or modified sequence opt4 from anti-HIV_cap256-119-003577_VR-Chain
caggugcagcugguggagagcggcggcggcggcgugcagcccggcagaagccugagacugagcugcgccgccagcggcuucaccuucagaagcuacgccaugcacugggugagacaggcccccggcaagggccuggaguggguggccgugaucagcaacgacggcaccaagaaguaccacgccgagagcgugugggacagauucagcaucagcaaggacaacagcaagaacacccuguuccugcagaugaacagccugagaguggaggacaccgcccuguacuucugcgugaaggaccagagagaggacgagugcgaggagugguggagcgacuacuacgacuucggcagagagcugcccugcagaaagagcagaggccugggccuggccggcaucuucgacauguggggccacggcaccauggugaccgugagcagc

SEQ ID NO: 32558 - RNA, 432 nt, Artificial Sequence
  derived and/or modified sequence opt4 from anti-HIV_cap256-119-002155_VR-Chain
cugggcagacugguggccagcggcggcggcguggugccccccggcagaagccugagacugagcugcguggccagccaguucaccuucagcggcugcggccugcacugggugagacaggugcccggcaagggccuggaguggguggccagcaucagcuucgccggcaccaagacccacuacggcaacagcgugaagggcagauucagcaucagcagagacaacagcaucaacaccguguaccugcagaugaacagccugagagccgaggacaccgcccuguacuacugcgccaaggaccugagagaguacgagugcgaggaguggaccagcgacuacuacgacuucggcagaccccagcccugcaucgacagcagaggcguggugggcauccuggacaucuggagccagggcaccauggugaccgugagcagc

SEQ ID NO: 32559 - RNA, 432 nt, Artificial Sequence
  derived and/or modified sequence opt4 from anti-HIV_cap256-119-002017_VR-Chain
caggugcagcugguggagagcggcggcggcguggugcagcccggcagaagccugagacugagcugcgccgccagcggcuucaccuucagcuacuacggcauccacugggugagacaggcccccggcaagggccuggaguggguggccagcaucagcuacgacgagagagacuucuaccacgccagaagcguguggggcagauucgccaucagcagagacaacagcaagaacacccugcaccugcagaugaacagccugagacccgaggacaccgcccuguacuucugcgccagagaccugagagagagcgagugcgaggagugggagagcuacuacuacgacuucggcaagaagggccccugcgugaagcccagaggcguggugggcgugcuggacaucuggggccagggcacccuggugaccgugagcagc

SEQ ID NO: 32560 - RNA, 432 nt, Artificial Sequence
  derived and/or modified sequence opt4 from anti-HIV_cap256-119-001312_VR-Chain
caggugcagcugauggagagcggcggcggcguggugcagcccggcagaagccugagacuggccugcgccgccagcggcuucaccuucagcagcuacgccauccacugggugagacaggcccccggcaagggccuggaguggguggccgccaucagcuucgccggcaccaagaagaacuacgccgacagcgugagaggcagauucaccaucagcagagacagcagcaagaacacccuguaccuggagaugaacagccugagacccgaggacaccgcccuguacuacugcgccaaggacaugagaggcuacgagugcgaggaguggaccagcgacuacuacgacuucggcagaccccagcccugcaucgacagcagaggcguggugggcaccuucgacguguggggccagggcaccauggugaccgugagcagc

SEQ ID NO: 32561 - RNA, 438 nt, Artificial Sequence
  derived and/or modified sequence opt4 from anti-HIV_cap256-119-001017_VR-Chain
cagaugcagcugguggagagcggcggcggcguggugcagcccggcagaagccugacccugagcugcgccgccagccaguucagcuucaccaacuacggcaugcacugggugagacaggcccccggcaagggccuggaguggguggccagcaucagcaacgacggcaacaagaaguaccacggcgagagcgugugggacagauucaccaucagcagagacaacagcaagaacacccuguuccugcagaugaacagacugagaguggaggacaccgcccuguacuucugcgugaaggaccagagagaggacgagugcgaggagugguggagcgacuacuacgacuucggcagagagcugcccugcagaaaguucagaggccugggccuggccggcaucuucgacguguggggccacggcaccauggugaccgugagcagc

SEQ ID NO: 32562 - RNA, 432 nt, Artificial Sequence
  derived and/or modified sequence opt4 from anti-HIV_cap256-119-000594_VR-Chain
caggugcagcugguggagagcggcggcggccuggugcagcccggcaccagccugagacugagcugcgccgccagcgccuucaccuucaagaacuacggcaugcacugggugagacaggcccccggcaagggccuggacuggguggccagcaucagcuacgacggcagagacaaguaccacagcagccugguguggggcagacugaccaucagcagagacaacagcaagagcacccuguuccugcagaugaacagccugagagccgaggacaccgcccuguacuacugcgccagagaccugagagagagcgagugcgaggaguggcagagcgacuacuacgccuucuacaagaagcugcccugcgugaagcccagaggcguggccggcacccuggacaucuggggccagggcaccauggugaccgugagcagc

SEQ ID NO: 32563 - RNA, 432 nt, Artificial Sequence
  derived and/or modified sequence opt4 from anti-HIV_cap256-059-241099_VR-Chain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucagcuacgacggcagcaacaaguacuacguggacagcgugcagggcagauucaccaucagcagagacaacagcaagaacaccauguuccugcagaugaacagccugagaaccgaggacaccgccguguacuacugcgccagagaccugggcgagagcgagguggaggagugggccaccgacuacuacgacuucagcaucgccuaccccguggagggccccagaggcguggugggcaucuucgacaucuggggccagggcaccauggugaccgugagcagc

SEQ ID NO: 32564 - RNA, 432 nt, Artificial Sequence
  derived and/or modified sequence opt4 from anti-HIV_cap256-059-207529_VR-Chain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccggcaucagcuucgccggcaucaacaaguacuacggcaacagcgugaagggcagauucaccaucagcagagacaacagcagaaacacccuguaccugcagaugaacagccugagagccgaggacaccgcccuguacuacugcgccagagaccugagagagauggagugcgaggagugggccagcgacuacuacgacuucggcagaggcggccccugccaggaccccagaggcguggugggcaccuucgacaucuggggccagggcaccauggugaccgugagcagc

SEQ ID NO: 32565 - RNA, 435 nt, Artificial Sequence
  derived and/or modified sequence opt4 from anti-HIV_cap256-059-205541_VR-Chain
cagaugcagcugguggagagcggcggcggcguggugcagcccggcggcagccugagacugagcugcgccgccagcggcuucagcuucagcuacuacgccauggacugggugagacaggcccccggcaagggccuggaguggguggccuucaucagcagcgacggcagcgacaagaacuacgccgacagcgugaagggcagauucaccaucagcagagacaacagcaagaacacccuguaccugcagaugaacagccugagagccgaggacaccgccguguacuacugcgccaaggacgugggcggccacaagaacgacgagugggccaccaacuacuacuacgacaucagcaucgccuaccccauccaggaccccagagccguggccggcgccuucgacguguggggccagggcaccauggugaccgugagcagc

SEQ ID NO: 32566 - RNA, 432 nt, Artificial Sequence
  derived and/or modified sequence opt4 from anti-HIV_cap256-059-188439_VR-Chain
caggugcagcugguggagagcggcggcggcguggugcagcccggcagaagccugagacugagcugcgccgccagccaguucaccuucagcaacuacggcaugcacugggugagacaggcccccggcaagggccuggaguggguggccgccaucagcuucgccggcaucaacaaguacuacaccgacagcgugaagggcagauucaccaucagcagagacaacagcaagaacacccuguaccugcagaugaacagccugagagccgaggacaccgcccuguacuacugcgccaaggaccugagaggcuucgagugcgaggagugggccagcgacuacuacgacuucggcagagaccugcccugccaggaccccagaggcguggugggcaccuucgacguguggggccagggcaccaaggugaccgugagcagc

SEQ ID NO: 32567 - RNA, 432 nt, Artificial Sequence
  derived and/or modified sequence opt4 from anti-HIV_cap256-059-187234_VR-Chain
caggugcagcugguggagagcggcggcggcguggugcaggccggcagaagccugagacugagcugcgccgccagccaguucaccuucggcagcuacggcaugcacugggugagacaggcccccggcaagggccuggaguggguggccgccaucagcuucgccggcaccaagauccacuacgccgacagcgugaagggcagauucaccaucagcagagacaacagcaagaacgcccuguaccugcagaugcacagccugagagccgaggacaccgcccuguacuacugcgccaaggaccugagagaguacgagugcgaggagugggccagcgacuacuacgacuucggcagagaccagcccugccaggaccccagaggcguggugggcaucuucgacaucuggggccagggcaccauggugaccgugagcagc

SEQ ID NO: 32568 - RNA, 432 nt, Artificial Sequence
  derived and/or modified sequence opt4 from anti-HIV_cap256-059-187047_VR-Chain
caggugcagcugguggagagcggcggcggcguggugcagcccggcagaagccugagacugagcugcgccgugagccagcugaccuucagcagcuacggcaugcacugggugagacaggcccccggcaagggccuggaguggguggccgccaucagcuucgugggcaucaagaaguacuacgccgacagcgugaagggcagauucaccaucagcagagacaacagcaagaacacccuguaccugcagaugaacagccugagaguggaggacaccgcccuguacuacugcgccaaggaccugagagaguacgagugcgaggagugggccagcgacuacuacgacuucggcagagaccagcccugccaggacgccagaggcguggugggcaccagcgacaucuggggccagggcaccauggugaccgugagcagc

SEQ ID NO: 32569 - RNA, 432 nt, Artificial Sequence
  derived and/or modified sequence opt4 from anti-HIV_cap256-059-186068_VR-Chain
caggugcagcugguggagagcggcggcggcguggugcagcccggcagaagccugagacugagcugcgccgccagccaguucagcuucagcaacuacggcaugcacugggugagacaggcccccggcaagggccuggaguggguggccggcaucagcuucgccgccaccaagaaguacuacgccgacagcgugaagggcagauucagcgugagcagagacaacagcaagaacgcccuguaccugcagaugaacagccugagagccgaggacaccgcccuguacuacugcgccagagaccugagagacuacgagugcgaggagugggccagcgacuacuacgacuucggcagagaguaccccugccaggaccccagaggcguggugggcaccuucgacaucuggggccagggcaccauggugaccgugagcacc

SEQ ID NO: 32570 - RNA, 435 nt, Artificial Sequence
  derived and/or modified sequence opt4 from anti-HIV_cap256-059-182835_VR-Chain
caggugcagcugguggagagcggcggcggccuggugcagcccggcagaagccugagacugagcugcgccgccagcggcuucagcuucaacaacuucgccauggacugggugagacaggcccccggcaagggccuggaguggguggccuucgugagcagcgacggcagcaacaagaacuacgccgacagcgugaagggcagauucaucaucagcagagacaacagcaagaacaccguguaccugcagaugaacagccugagaguggaggacaccgccguguacuacugcgccaaggaccugggcgccaacaaggacgacgagugggccaccgacuacuacuacgaccugagcguggccagacccgugcccgaccccagagccguggugggcgccuucgacguguggggccagggcaccauggugaccgugagcagc

SEQ ID NO: 32571 - RNA, 432 nt, Artificial Sequence
  derived and/or modified sequence opt4 from anti-HIV_cap256-059-176659_VR-Chain
agagugcagcugguggagagcggcggcggcguggugcagcccggcagaagccugagacugagcugcgccgccagccaguucagcuucagcaacuacggcaugcacugggugagacaggcccccggcaagggccuggaguggguggccggcaucagcuucgccgccaucaagaaguacuacgccgacagcgugaagggcagauucaccaucagcagagacaacagcaagaacgcccuguaccugcagaugaacagccugagagccgaggacaccgcccuguacuacugcgccagagaccugagagaguacgagugcgaggagugggccagcgacuacuacgacuucggcagagagcugcccugccaggaccccagaggcguggugggcaccuucgacaccuggggccagggcaccauggugaccgugagcacc

SEQ ID NO: 32572 - RNA, 432 nt, Artificial Sequence
  derived and/or modified sequence opt4 from anti-HIV_cap256-059-172956_VR-Chain
caggugcagcugguggagagcggcggcggcguggugcagcccggcagaagccugagacugagcugcgccgccagccaguucagcuucagcagcuacggcaugcacugggugagacaggcccccggcaagggccuggaguggguggccgccaugagcuucgccggcaccaaccaguacuacgccgccagcgugaagggcagauucaccaucagcagagacaacagcaagaacacccuguaccugcacaugaacagccugagacccgaggacaccgcccuguacuacugcgccagagaccugagagaguacgagugcgaggagugggccgccgacuacuacgacuucggcagagaguaccccugccaggaccccagaggcguggugggcaucuucgacguguggggccagggcacccuggugaccgugagcagc

SEQ ID NO: 32573 - RNA, 432 nt, Artificial Sequence
  derived and/or modified sequence opt4 from anti-HIV_cap256-059-171272_VR-Chain
caggugcugcugguggagagcggcggcggcguggugcagcccggcagaagccugagacugagcugcgccgccagccaguucaccuucagcaacuacggcaugcacugggugagacaggcccccggcaagggccuggaguggguggccgccaucagcuucgccggcaugaagaaguacuacgccgacagcgugaagggcagauucaccaucagcagagacaacagcaagaacacccuguaccugcagaugaacagccugagagccgaggacaccgcccuguacuacugcgccaaggaccugagagaguucgagugcgaggagugggccagcgacuacuacgacuucggcagagcccagcccugccaggaccccagaggcguggugggcaccuucgaccuguggggccagggcaccauggugaccgugagcagc

SEQ ID NO: 32574 - RNA, 432 nt, Artificial Sequence
  derived and/or modified sequence opt4 from anti-HIV_cap256-059-168734_VR-Chain
caggugcagcugguggagagcggcggcggcguggugcagcccggcagaagccugagacugagcugcaccgccagccaguucagcuucagcagcuacggcaugcacugggugagacaggcccccggcaagggccuggaguggguggccgccaucagcuucgccggcaccaagaaguacuacgugggcaccgugaagggcagauucaccaucagcagagacaacagcaagaacacccuguaccugcagaugaacagccugagagccgaggacaccgcccuguacuacugcgccaaggacaugagagaguacgagugcgaggagugggccagcgacuacuacgacuucggcagagaguaccccugccaggaccccagaggcguggugggcaccuucgacaucuggggccagggcaccauggugaccgugagcagc

SEQ ID NO: 32575 - RNA, 432 nt, Artificial Sequence
  derived and/or modified sequence opt4 from anti-HIV_cap256-059-155838_VR-Chain
caggugcagcugguggagagcggcggcggcguggugcagcccggcagaagccugagacugagcugcgccgugagccaguucaccuucagcaacuacggcaugcacugggugagacaggcccccggcaagggccuggaguggguggccgccaucagcuucgccggcaccaagaagagcuacgccgccagcgugaagggcagauucaccaucagcagagacaacagcaagaacacccuguaccugcagaugaacagccugagacccgaggacaccgcccuguacuacugcgccaaggacaugagaggcuucgagugcgaggagugggccagcgacuacuacgacuucggcagagagcagcccugccaggaccccagaggcguggugggcaucuucgaccuguggggccagggcaccauggugagcgugagcagc

SEQ ID NO: 32576 - RNA, 432 nt, Artificial Sequence
  derived and/or modified sequence opt4 from anti-HIV_cap256-059-149799_VR-Chain
caggugcaccugguggagagcggcggcggcguggugcagcccggcagaagccugagacugagcugcgccgccagccaguucaccuucagcaacuacggcuuccacugggugagacaggcccccggcaagggccuggaguggguggccgccaucagcuucgccggcgugaagaagcacuacgccgacagcgugaagggcagauucaccaucagcagagacaacagcaagaacacccuguaccugcagcugaacagccugagagccgaggacaccgcccuguacuacugcgccaaggaccugagagaguacgagugcgaggagugggccagcgacuacuacgacuucggcagagacuuccccugccaggaccccagaggcguggugggcaccuucgacaucuggggccagggcaccauggugaccgugagcagc

SEQ ID NO: 32577 - RNA, 432 nt, Artificial Sequence
  derived and/or modified sequence opt4 from anti-HIV_cap256-059-148168_VR-Chain
caggugcagcugguggagagcggcggcggcguggugcagcccggcagaagccugagacugagcugcaccgccagccaguucaccuucagcaacuacggcaugcacugggugagacaggcccccggcaagggccuggaguggguggccggcaucagcuucgccgccaccaagaaguacuacagcgacagcgugaagggcagauucaccaucagcagagacaacagcaagaacgcccuguaccugcagaugaacagccugagagccgaggacaccgcccuguaccacugcgccaaggaccugagagaguacgagugcgaggagugggccagcgacuacuacgacuucggcagagagcagcccugccaggaccccagaggcguggugggcaccuucgacaucuggggccagggcaccauggugaccgugagcacc

SEQ ID NO: 32578 - RNA, 435 nt, Artificial Sequence
  derived and/or modified sequence opt4 from anti-HIV_cap256-059-144685_VR-Chain
caggugcaccugguggagagcggcggcggcguggugcagcccggcagaagccugagacugagcugcgccgccagcggcuucaccuucagcaacuucgccauggacugggugagacaggcccccggcaagggccuggaguggguggccuucgugagcagcgacggcaacaacaagaacuacggcgacagcgugaagggcagauucaccaucagcagagacaacagcaagaacacccuguuccugcagaugaacagccugagagccgaggacaccgcccuguacuacugcgugaaggacgugggcgacuacaagagcgacgagugggccacccacuacuacuacgaccugagcaucgccgaccccauccaggaccccagagccguggugggcgccuucgacaucuggggcagaggcaccaugguggccgugagcagc

SEQ ID NO: 32579 - RNA, 432 nt, Artificial Sequence
  derived and/or modified sequence opt4 from anti-HIV_cap256-059-140017_VR-Chain
caggugcagcugguggagagcggcggcggcguggugcagcccggcagaagccugagacugagcugcgccgccagccaguucagcuucggcaacuucggcaugcacugggugagacaggcccccggcaagggccuggaguggguggccggcaucagcuucgccggcaccaagaaguacuacgccgacagcgugaagggcagauucaccaucagcagagacaacagcaagagcgcccuguuccugcagaugaacagccugagagccgaggacaccgcccuguacuacugcgccaaggaccugagauacuacgagugcgaggagugggccagcgacuacuacgacuucggcagagaccagcccugccaggaccccagaggcguggugggcaccuucgacauguggggccagggcaccauggugaccgugagcagc

SEQ ID NO: 32580 - RNA, 432 nt, Artificial Sequence
  derived and/or modified sequence opt4 from anti-HIV_cap256-059-137547_VR-Chain
caggugcagcugguggagagcggcggcggcguggugcagcccggcagaagccugagacugagcugcgccgccagccaguucaccuucagcagauacggcaugcacugggugagacaggcccccggcaagggccuggaguggguggccgccaucagcuucgccggcaucaagaagaacuacgccgacagcgugaagggcagauucaccaucagcagagacaacagcaagaacacccuguaccugcagaugaacagccugagagccgaggacaccgcccuguacuacugcgccagagaccugagagaguucgagugcgaggagugggccagcgacuacuacgacuucggcagagacuuccccugccaggaccccagaggcguggugggcaucuucgacaucuggggccagggcaccauggugaccgugagcagc

SEQ ID NO: 32581 - RNA, 435 nt, Artificial Sequence
  derived and/or modified sequence opt4 from anti-HIV_cap256-059-131908_VR-Chain
caggugcagcugguggagagcggcggcggcguggugcagcccggcagaagccugagacugagcugcaccgccagcggcuucaccuucagcaacuacggcauccacugggugagacaggcccccggcaagggccuggaguggguggccgccaucagcuacgagggcagcaucaaguacuacguggacagcgugaagggcagauucaccaucagcagagacgacagcaagaacacccuguuccugcagaugaacagccugagaaccgaggacaccgccguguacuacugcaccagagacgugagagagugggagaccgaggagugggccaccaacuacuacuacgaccugagcaucgccuaccccaucagacaccccagaggcguggugggcaucuucgacguguggggccugggcaccagagugaccgugagcagc

SEQ ID NO: 32582 - RNA, 432 nt, Artificial Sequence
  derived and/or modified sequence opt4 from anti-HIV_cap256-059-116006_VR-Chain
caggcccagcugguggagagcggcggcggcguggugcagcccggcagaagccugagacugagcugcgccgccagccaguucagcuucagcagcuacggcaugcacugggugagacaggcccccggcaagggccuggaguggguggccagcaucagcuucgccggcgugaagaagaccaacgccgacagcgugaagggcagauucaccaucagcagagacaacagcaagaacacccugcaccugcagaugaacggccugagaaacgacgacaccgcccuguacuacugcgccagagaccugagagacuucgagugcgaggagugggccagcgacuacuacgacuucggcagagaguuccccugccaggaccccagaggcguggugggcaccuucgacaucuggggccagggcaccaaggugaccgugagcagc

SEQ ID NO: 32583 - RNA, 411 nt, Artificial Sequence
  derived and/or modified sequence opt4 from anti-HIV_cap256-059-115783_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccgccaucagcuacgccgacagcgugaagggcagauucaccaucagcagagacaacagcaagaacacccuguaccugcagaugaacagccugagagccgaggacaccgcccuguacuacugcgccaaggaccugagagagauggagugcgaggagugggccagcgacuacuacgacuucggcagagaccugcccugccaggaccccagaggcguggugggcacccuggacaucuggggccagggcaccauggugaccgugagcagc

SEQ ID NO: 32584 - RNA, 432 nt, Artificial Sequence
  derived and/or modified sequence opt4 from anti-HIV_cap256-059-114609_VR-Chain
caggugcagcugguggagagcggcggcggcguggugcagcccggcagaagccugagacugagcugcgccgccagccagcugaccuucagcaacuucggcaugcacugggugagacaggcccccggcaagggccuggaguggguggccggcaucagcuucgccggcaccaagaaguacuacgccgacagcgugaagggcagauucaccaucagcagagacaacagcaagaacgcccuguaccugcagaugaacacccugagagccgaggacaccgcccuguacuucugcgccaaggaccugagagaguacgagugcgaggagugggccagcgacuacuacgacuucggcagagaccagcccugccaggaccccagaggcguggugggcaucuucgacaucuggggccagggcaccauggugaccgugagcagc

SEQ ID NO: 32585 - RNA, 432 nt, Artificial Sequence
  derived and/or modified sequence opt4 from anti-HIV_cap256-059-113952_VR-Chain
caggcccagcugguggagagcggcggcggcguggugcagcccggcagaagccugagacugagcugcgccgccagccacuucaccuucagcagcuacggcuuccacugggugagacaggcccccggcaagggccuggaguggguggccggcaucagcuucgccgccaccaagaaguacuacgccgacagcgugaagggcagauucaccaucagcagagacaacagcaaggacgcccuguaccugcagaugaacagccugagagccgaggacaccgcccuguacuacugcgccagagaccugagaggcuacgagugcgaggagugggccagcgacuacuacgacuucggcagagaccagcccugccaggaccccagaggcguggugggcaucuucgaccuguggggccagggcaccauggugaccgugagcagc

SEQ ID NO: 32586 - RNA, 432 nt, Artificial Sequence
  derived and/or modified sequence opt4 from anti-HIV_cap256-059-113878_VR-Chain
caggugcagcugguggagagcggcggcggcguggugcagcccggcagaagccugagacugagcugcgccgccagcggcuucaccuucagcaccuacgccaugcacugggugagacaggcccccggcaagggccuggaguggguggcccugaucagcuacgacgccaccaacaaguacuacguggacagcgugaagggcagauucaccaucagcagagacaacagcaagaacacccuguaccugcagaugagcagccugaccgccgaggacaccgccguguacuacugcgccaaggaccugggcggcaucaagaucgacgaguggggcaccgacuacuacgacaucagcgugagcuaccccgugcaggaccccagagccguggccggcaucuucgacguguggggccacggcaccauggugagcgugagcagc

SEQ ID NO: 32587 - RNA, 432 nt, Artificial Sequence
  derived and/or modified sequence opt4 from anti-HIV_cap256-059-113622_VR-Chain
caggugcagcugguggagagcggcggcggcguggugcagcccggcagaagccugagacugagcugcgccgccagccaguucaccuucaccagcuacggcaugcacugggugagacaggcccccggcaagggccuggaguggguggccggcaucagcuucgccggcaccaagaagcacuacgccgacagcgugaagggcagauucaccaucagcagagacaacagcaagagcacccuguaccugcagaugaacagccugagagccgaggacaccgcccuguacuacugcgccaaggacaugagagaguacgagugcgaggagugggccagcgacuacuacgacuucggcagagaccagcccugccaggaccccagaggcguggugggcaucuucgaccuguggggccagggcaccauggugaccgugagcagc

SEQ ID NO: 32588 - RNA, 432 nt, Artificial Sequence
  derived and/or modified sequence opt4 from anti-HIV_cap256-059-109427_VR-Chain
caggugcagcugguggagagcggcggcggcguggugcagcccggcagaagccugagacugagcugcgccgccagccaguucaccuucagcaacuacggcaugcacugggugagacaggcccccggcaagggccuggaguggguggccagcaucagcuucgccggcaucaagaagcacuacaccgacagcgugaagggcagauucaccaucagcagagacaacagcaagaacacccuguuccugcagaugaacagccugagagccgaggacaccgcccuguacuacugcgccagagaccugagagaguacgagugcgaggagugggccagcgacuacuacgacuucggcagagaccagcccugccaggaccccagaggcguggugggcaccagcgacaucuggggccagggcaccaaggugaccgugagcagc

SEQ ID NO: 32589 - RNA, 432 nt, Artificial Sequence
  derived and/or modified sequence opt4 from anti-HIV_cap256-059-109081_VR-Chain
caggagcagcugguggagagcggcggcggcguggugcagcccggcagaagccugagacugagcugcgccgccagccaguucagcuucagcgccuacggcaugcacugggugagacaggcccccggcaagggccuggaguggguggccggcaucagcuucgccgccaccaagaaguacuacgaggacagcgugaagggcagauucaccaucagcagagacaacagcaagaacacccuguaccugcagaugaacagccugagaggcgaggacaccgcccuguacuacugcgccaaggacaugagagagauggagugcgaggagugggccagcgacuacuacgacuucggcagaccccagcccugccaggaccccagaggcguggugggcaucuucgacauguggggccagggcaccauggugaccgugagcagc

SEQ ID NO: 32590 - RNA, 432 nt, Artificial Sequence
  derived and/or modified sequence opt4 from anti-HIV_cap256-059-107590_VR-Chain
caggagcagcugguggagagcggcggcggcguggugcagcccggcagaagccugagacugagcugcgccgccagccaguucagcaucagcgccuacggcaugcacugggugagacaggcccccggcaagggccuggaguggguggccggcaucagcuucgccggcaccaagaaguacuacgccgacagcgugaagggcagauucaccaucagcagagacaacagcaagaacacccuguaccugcagaugaacagccugagaggcgaggacaccgcccuguacuacugcgccaaggacaugagagagauggagugcgaggagugggccagcgacuacuacgacuucggcagagaccagcccugccaggaccccagaggcguggugggcaucuucgacauguggggccagggcaccauggugaccgugagcagc

SEQ ID NO: 32591 - RNA, 435 nt, Artificial Sequence
  derived and/or modified sequence opt4 from anti-HIV_cap256-059-107504_VR-Chain
caggugcugcugguggagagcggcggcggcguggugcagcccggcaagagccugagacugagcugcagcgccagcagauucaccuucagcaacuacggcaugcacugggugagacaggcccccggcaagggccuggaguggguggccgccgugagcuucgccggcaucaagaagaccaacgccgacagcgugaagggcagauucaccaucagcagagacaacagcaagaacacccuguaccugcagaugaacagccugagagccgaggacaccgcccuguacuacugcgccagagaccugagagacuucgagugcgaggagugggccagcgacuacuacgacuucuggggcgacccccagcccugccaggaccccagaggcguggugggcaccuucgaccuguggggccagggcaccauggugaccgugagcagc

SEQ ID NO: 32592 - RNA, 432 nt, Artificial Sequence
  derived and/or modified sequence opt4 from anti-HIV_cap256-059-099614_VR-Chain
gaggugcugcugcuggagagcggcggcggccuggugcagcccggcagaagccugagacugagcugcgccgccagccaguucaccuucagcagcuacggcaugcacugggugagacaggcccccggcaagggccuggaguggguggccggcaucagcuucgugggcaucaagaaguacuacgccgacagcgugaagggcagauucaccaucagcagagacaacagcaagaacacccuguaccugcagaugaacagccugagagccgaggacaccgcccuguacuacugcgccagagaccugagagaguacgagugcgaggagugggccagcgacuacuacgacuucggcagagaccagcccugccaggaccccagaggcguggugggcaccuucgacaucuggggccagggcaccauggugaccgugagcagc

SEQ ID NO: 32593 - RNA, 432 nt, Artificial Sequence
  derived and/or modified sequence opt4 from anti-HIV_cap256-059-098972_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccagcaucagcuucgccggcaucaagaagaacuacagagacagcgugaagggcagauucaccaucagcagagacaacagcaagaacacccuguaccugcagaugaccagccugagacccgaggacaccgcccuguacuacugcgccaaggaccugagaggcuucgagugcgaggagugggccagcgacuacuacgacuucggcagagagcugcccugccaggaccccagaggcguggugggcaccuucgacauguggggccagggcaccauggugaccgugagcagc

SEQ ID NO: 32594 - RNA, 432 nt, Artificial Sequence
  derived and/or modified sequence opt4 from anti-HIV_cap256-059-097236_VR-Chain
caggugcagcugguggagagcggcggcggcguggugcagcccggcagaagccugagacugagcugcgccgccagcggcuucagcuucagcaacuucggcuuccacugggugagacaggcccccggcaagggccuggaguggguggccgccaucagcuucgugggcaacaagaaguacuacgccgagagcgugaagggcagauucaccaucagcagagagaacagcaagaacaugcuguuccugcagaugaacagccugagaggcgaggacaccgccguguacuacugcgccaaggaccugagagaguucgagugcgaggagugggccagcgacuacuacgacuucggcagagagcagcccugccaggaccccagaggcguggugggcagcaucgacguguggggccacggcagccuggugaccgugagcagc

SEQ ID NO: 32595 - RNA, 432 nt, Artificial Sequence
  derived and/or modified sequence opt4 from anti-HIV_cap256-059-091487_VR-Chain
caggugcagcugguggagagcggcggcggcguggugcagcccggcagaagccugagacugagcugcgccgccagccaguucaccuucaacagauacggcaugcacugggugagacaggcccccggcaagggccuggaguggguggccgugaucagcuacgacggcaccaacaaguacuacggcgagagcgugaagggcagauucaccaucagcagagacaacagcaagaacacccuguaccugcagaugaacagccugagagccgaggacaccgcccuguacuacugcgccaaggaccugagagaggacgagugcgaggagugguggagcgacuacuacgacuucggcagagagcugcccugcagaaagagcagaggcguggccggcaucuucgacaucuggggccagggcaccauggugaccgugagcagc

SEQ ID NO: 32596 - RNA, 432 nt, Artificial Sequence
  derived and/or modified sequence opt4 from anti-HIV_cap256-059-089812_VR-Chain
caggugcagcugguggagagcggcggcggcguggugcagcccggcagaagccugagacugagcugcgccgccagccagcugaccuucagcagcuacggcaugcacugggugagacaggcccccggcaagggccuggaguggguggccggcaucagcuucgccggcaccaagaagcacuacagcgacagcgugaagggcagauucaccaucagcagagacaacagcaagaacgcccuguaccugcagaugaacagccugagagccgaggacaccgcccuguacuacugcgccaaggaccugagagaguacgagugcgaggagugggccagcgacuacuacgacuucggcagagagcagcccugccaggaccccagaggcguggugggcaucuucgacauguggggccagggcaccauggugaccgugagcagc

SEQ ID NO: 32597 - RNA, 432 nt, Artificial Sequence
  derived and/or modified sequence opt4 from anti-HIV_cap256-059-088468_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccgccaucagcuucgugggcaucaagaaguacuacgccaacagcgugaagggcagauucaccaucagcagagacaacagcaagaacacccuguaccugcagaugaacagccugagagccgaggacaccgcccuguacuacugcgccagagaccugagagaguacgagugcgaggagugggccagcgacuacuacgacuucggcagaggcggccccugccaggaccccagaggcguggugggcagcuucgacaucuggggccagggcaccauggugaccgugagcagc

SEQ ID NO: 32598 - RNA, 432 nt, Artificial Sequence
  derived and/or modified sequence opt4 from anti-HIV_cap256-059-088341_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccgccaucagcuucgccggcaucaagaagcacuacgccgacagcgugaagggcagauucaccaucagcagagacaacagcaagaacaugguguuccugcagaugaacagccugagagccgaggacaccgcccuguacuacugcgccagagaccugagagaguacgagugcgaggagugggccagcgacuacuacgacuucggcagagaccagcccugccaggaccccagaggcguggugggcaccagcgacaucuggggccagggcaccauggugaccgugagcagc

SEQ ID NO: 32599 - RNA, 432 nt, Artificial Sequence
  derived and/or modified sequence opt4 from anti-HIV_cap256-059-086533_VR-Chain
caggugcugcugguggagagcggcggcggcguggugcagcccggcagaagccugagacugagcugcgccgccagccaguucaccuucagcaacuucggcaugcacugggugagacaggcccccggcaagggccuggaguggguggccggcaucagcuucgugggcaucaagaaguacuacgccggcagcgugaagggcagauucaccaucagcagagacaacagcaagaacacccuguaccugcagaugaacagccugagagccgaggacaccgcccuguacuacugcgccaaggaccugagagaguucgagugcgaggagugggccagcgacuacuacgacuucggcagaccccagcccugccaggaccccagaggcguggugggcaccuucgaccuguggggccugggcacccuggugaccgugagcagc

SEQ ID NO: 32600 - RNA, 432 nt, Artificial Sequence
  derived and/or modified sequence opt4 from anti-HIV_cap256-059-086043_VR-Chain
gaggugcaccugguggagagcggcggcggccuggugaagcccggcggcagccugagacugagcugcgccgccagcggcuucaccuucagcaccuacagcaugaacugggugagacaggcccccggcaagggccuggaguggguggccuucguggccuucgacgagagcgacaaguacuacgccgacagcgugaagggcagauucaccaucagcagagacaacagcaagaacacccugagccugcagaugaacagccugagaguggaggacaccgccaucuacuacugcgccaaggaggugggcgacaacaaggacgacgagugggccagcgacuacuacgaccugagcaucgccuaccccauccaggaccccagagccgugggcagaggcuacgacaucuggggccagggcaccauggugaccgugagcagc

SEQ ID NO: 32601 - RNA, 432 nt, Artificial Sequence
  derived and/or modified sequence opt4 from anti-HIV_cap256-059-084191_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccgccaucagcuucgugggcaucaagaaguacuacgccgacagcgugaagggcagauucaccgugagcagagacaacagcaagagcacccuguaccugcagaugaacagccugagagccgaggacaccgcccuguacuacugcgccagagaccugagagaguacgagugcgaggagugggccagcgacuacuacgacuucggcagagaccagcccugccaggaccccagaggcguggugggcaucuucgacaucuggggccagggcaccgccgugaccgugagcagc

SEQ ID NO: 32602 - RNA, 417 nt, Artificial Sequence
  derived and/or modified sequence opt4 from anti-HIV_cap256-059-082135_VR-Chain
caggugcagcugguggagagcggcggcggcguggugcagcccggcagaagccugagacugagcugcaccgccagcggcuucaccuucagaagcuacgccauccacugggugagacaggcccccggcaagggccuggaguggguggcccugaucagcuacgacggcagcaacaaguacuacgccgacagcgugaagggcagauucaccaucagcagagacaacagcaagaacacccuguaccugcagaugaacagccugaccagcgaggacaccgccguguacuacugcgccaaggaccugggcggcagcaagaccgacgaguggggcaccgacuacugcuaccccgugcaggaccccagagugguggugggcgccuucgacaucuggggccacggcaccauggugaccgugagcagc

SEQ ID NO: 32603 - RNA, 432 nt, Artificial Sequence
  derived and/or modified sequence opt4 from anti-HIV_cap256-059-079417_VR-Chain
caggugcagcugguggagagcggcggcggcguggugcagcccggcagaagccugagacugagcugcgccgccagcggcuucagcuucagcaacuacgccauggacugggugagacaggcccccggcaagggccuggaguggguggccuucgugagcagcgacggcaacaacaagaaguacgccgacagcgugaagggcagauucacccugagcagagacaacuacaagaacaccguguaccugcagaugaacagccugaccguggaggacaccgccguguacuacugcgccaaggaccugggcgccaacaaggacgacgaguggggcaccgacuacuacgacaugagcgugagcuaccccauccccgaccccagagccguggugggcgccuucgacguguggggccagggcacccuggugaccgugagcagc

SEQ ID NO: 32604 - RNA, 435 nt, Artificial Sequence
  derived and/or modified sequence opt4 from anti-HIV_cap256-059-076027_VR-Chain
caggugcagcugguggagagcggcggcggcguggugcagcccggcagaagccugagacugagcugcgccgccagcggcuucagcuucagcaaguacggcaugcacugggugagacaggcccccggcaagggccuggaguggguggccuucguggccuucgacgagagcgagaaguacuacgccgccagcgugaagggcagauucaccaucagcagagacaacagcaagaacacccugagccugcagaugaacagccugagaaccgaggacaccgccaucuacuacugcgccaaggaggugggcgacaacaaggacgacgaguggaccagccccuacuacuacgacaucagcaucgccuaccccgugcacgaccccagagccguggugggcgugagcgacguguggggccagggcaccauggugaccgugagcagc

SEQ ID NO: 32605 - RNA, 432 nt, Artificial Sequence
  derived and/or modified sequence opt4 from anti-HIV_cap256-059-075082_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccgccaucagcuucgugggcaucaagaaguacuacgccgacagcgugaagggcagauucaccaucagcagagacaacagcaagaacacccuguaccugcagaugaacagccugagagccgaggacaccgcccuguacuacugcgccaaggaccugagagagauggagugcgaggagugggccagcgacuacuacgacuucggcagagaccugcccugccaggaccccagaggcguggugggcacccuggacaucuggggccagggcaccauggugaccgugagcagc

SEQ ID NO: 32606 - RNA, 432 nt, Artificial Sequence
  derived and/or modified sequence opt4 from anti-HIV_cap256-059-072575_VR-Chain
cagggccagcugguggagagcggcggcggcguggugcagcccggcagaagccugagacugagcugcgccgccagccaguucaccuucagcaacuucggcaugcacugggugagacaggcccccggcaagggccuggaguggguggccgugaucagcuacgacggcaccaagaaguacuacgccgacagcgugaagggcagauucaccaucagcagagacaacagcaagaacacccuguaccugcagaugaacagccugagagccgaggacaccgcccuguacuacugcgccaaggacaugagagaggacgagugcgaggaguggggcgccgacuacuacgacuucggcaaggacuaccccugccaggccagcagaggcguggugggcaucuucgacaucuggggccagggcaccauggugaccgugagcgcc

SEQ ID NO: 32607 - RNA, 432 nt, Artificial Sequence
  derived and/or modified sequence opt4 from anti-HIV_cap256-059-071926_VR-Chain
caggugcagcugguggagagcggcggcggcguggugcagcccggcagaagccugagacugagcugcgccgccagccagcugagcuucagcaacuacggcaugcacugggugagacaggcccccggcaagggccuggaguggguggccggcaucagcuucgugggcaucaagaaguacuacagagacagcgugaagggcagauucaccaucagcagagacaacagcaagaacacccuguaccugcagaugaacagccugagaaccgaggacaccgcccuguacuacugcgugaaggaccugagagaguucgagugcgaggagugggccagcgacuacuacgacuucggcagagaccagcccugccuggaccccagaggcguggugggcaccuucgacaucuggggccagggcaccauggugaccgugagcagc

SEQ ID NO: 32608 - RNA, 432 nt, Artificial Sequence
  derived and/or modified sequence opt4 from anti-HIV_cap256-059-069638_VR-Chain
caggugcagcugguggagagcggcggcggcguggugcagcccggcagaagccugagacugagcugcgccgccagcggcuucaccuucagcaagaacgccaugcacugggugagacaggcccccggcagaggccuggaguggguggccagcguggccuucgacggcagcgacaaguacuacgccgacagcgugaagggcagauucaccaucagcagagacaacagcaagaacacccugagccugcagaugaacagccugagagccgaggacaccgccguguacuacugcgccaaggagguggaccuguacaaggacgacgaguggggcagcgacuacuacgaccugagcaucgccuaccccauccaggaccccagagccguggugggcggcuucggcaucuggggccagggcaccauggugaccgugagcagc

SEQ ID NO: 32609 - RNA, 432 nt, Artificial Sequence
  derived and/or modified sequence opt4 from anti-HIV_cap256-059-069165_VR-Chain
cuggugcagcugguggagagcggcggcggcguggugcagcccggcagaagccugagacugagcugcgccgccagcagauucaccuucagcaacuacggcaugcacugggugagacaggcccccggcaagggccuggaguggguggccggcaucagcuucgccggcaccaccaaguacuacgccgacagcgugagaggcagauucaccaucagcagagacaacagcaagaacacccuguaccugcagaugaacagccugagagccgaggacaccgcccuguacuacugcgccaaggacaugagagagauggagugcgaggagugggccagcgacuacuacgacuucggcagaccccagcccugccaggaccccagaggcguggugggcaucuucgacaucuggggccagggcaccauggugaccgugagcagc

SEQ ID NO: 32610 - RNA, 432 nt, Artificial Sequence
  derived and/or modified sequence opt4 from anti-HIV_cap256-059-068956_VR-Chain
caggugcagcugguggagagcggcggcggcguggugcagcccggcagaagccugagacugagcugcgccgccagcggcuucaccuucagcaccuacgccaugcacugggugagacaggcccccggcagaggccuggaguggguggcccugaucagcuacgacggcagcaacaaguacuacguggacagcgugaagggcagauucaccaucagcagagacaacagcaagaacacccuguaccugcagaugaacagccugaccgccgaggacaccgccguguacuacugcgccaaggaccugggcggcagcaaggacgacgagugggccaccgacuacuacgaccugagcaucgccuaccccauccaggaccccagagccguggccggcaucuucgacguguggggcagaggcaccguggugaccgugagcagc

SEQ ID NO: 32611 - RNA, 432 nt, Artificial Sequence
  derived and/or modified sequence opt4 from anti-HIV_cap256-059-068876_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccgccaucagcuucgccggcaccaagaaguacuacgccaacagcgugaagggcagauucaccaucagcagagacaacagcaagaacacccugagccugcagaugaacagccugagaggcgaggacaccgccagauacuacugcgccagagaccccagagaguacgagugcgaggagugggccagcgacuacuacgacuucggcagagaccagcccugccaggaccccagaggcgugaucggcaucuucgacaucuggggccagggcaccauggugaccgugagcagc

SEQ ID NO: 32612 - RNA, 432 nt, Artificial Sequence
  derived and/or modified sequence opt4 from anti-HIV_cap256-059-067733_VR-Chain
caggugcagcugguggagagcggcggcggcguggugcagcccggcagaagccugagacugagcugcaccgccagccaguucagcuucagcagcuacggcaugcacugggugagacaggcccccggcaagggccuggaguggguggccgccaucagcuucgccggcaccaagaagaacuacguggacagcgugaagggcagauucaccaucagcagagacaacagcaagaacacccuguaccugcagaugaacagccugagagccgacgacaccgcccuguacuacugcgccaaggacaugagagaguacgagugcgaggagugggccagcgacuacuacgacuucggcagagaguaccccugcaccgaccccagaggcguggugggcaccuucgacguguggggccagggcaccauggugaccgugagcagc

SEQ ID NO: 32613 - RNA, 432 nt, Artificial Sequence
  derived and/or modified sequence opt4 from anti-HIV_cap256-059-067450_VR-Chain
caggugcagcugguggagagcggcggcggcguggugcagcccggcagaagccugagacugagcugcgccgccagccaguucaccuucagcaacuacggcaugcacugggugagacaggcccccggcaagggccuggaguggguggccggcaucagcuucgccggcaucaagaaguacuacgccgacagcgugaagggcagauucaccaucagcagagacaacgccaagaacacccuguaccugcagaugaacagccugagagccgaggacaccgcccuguacuacugcgccaaggaccugagagaguacgagugcgaggagugggccagcgacuacuacgacuucggcagagagcugcccugccaggaccccagaggcguggugggcaccuucgacaucuggggccagggcaccauggugaccgugagcagc

SEQ ID NO: 32614 - RNA, 432 nt, Artificial Sequence
  derived and/or modified sequence opt4 from anti-HIV_cap256-059-065694_VR-Chain
caggugcagcugguggagagcggcggcggcguggugcagcccggcagaagccugagacugagcugcgccgccagccagcugaccuucaacaacuacggcaugcacugggugagacagacccccggcaagggccuggaguggguggccggcaucagcuucgccggcaucaacaaguacuacgccgacagcgugaagggcagauucaccaucagcagagacaacagcaagaacgcccuguaccugcagaugaccagccugagagccgaggacaccgcccuguacuacugcgugaaggaccugagagagauggagugcgaggagugggccagcgacuacuacgacuucggcagagaccagcccugccaggaccccagaggcguggugggcaccuucgacaucuggggccagggcaccauggugaccgugagcagc

SEQ ID NO: 32615 - RNA, 432 nt, Artificial Sequence
  derived and/or modified sequence opt4 from anti-HIV_cap256-059-065109_VR-Chain
caggugcagcugguggagagcggcggcggcguggugcagcccggcaagagccugagacugagcugcgccgccagcggcuucaccuucaccaacaacgccaugaacugggugagacaggcccccggcaagggccuggaguggguggccuucgugagcagcgacggcagaaacaagaacuacgccgacagcgugaagggcagauucaccaucagcagagacaacagcaagaacaccguguaccugcagaugaacagccugagaguggaggacaccgcccuguacuacugcgccaaggaccugggcgccaacaaggacgacgagugggccaccgacuacuacgaccugagcguggccuaccccauccccgaccccagagccguggugggcgccuucgacguguggggccagggcaccauggugaccgugagcagc

SEQ ID NO: 32616 - RNA, 432 nt, Artificial Sequence
  derived and/or modified sequence opt4 from anti-HIV_cap256-059-065060_VR-Chain
caggugcagcugguggagagcggcggcggcguggugcagcccggcaccagccugagacugagcugcgccgccagcggcuucaccuucagcaacuacgccaugggcugggugagacaggcccccggcaagggccuggaguggguggccguggugagcuacgacggcagcaagaagagcuacgccgacagcgugaagggcagauucaccaucagcagagacaacagcagaaacacccuguaccugcagcugaacagccugagagccgaggacaccgccauguucuacugcgccaaggaccugggcaagggcgagaucgaggagugggccaccgacuacuacgacuggagcaaggccuaccccaucgagggccccagagacguggugggcgccuucgacaccuggggccagggcacccuggugaccgugagcagc

SEQ ID NO: 32617 - RNA, 432 nt, Artificial Sequence
  derived and/or modified sequence opt4 from anti-HIV_cap256-059-064001_VR-Chain
caggugcagcugguggagagcggcggcggcguggugcagcccggcagaagccugagacugagcugcgccgccagccaguucaccuucagcaacuacggcaugcacugggugagacaggcccccggcaagggccuggaguggguggccggcaucagcuucgccggcaccaagaacuacuacgccaagagcgugaagggcagauucaccaucagcagagacaacagcaagaacgcccuguaccugcagaugaacagccugagagccgaggacaccgcccuguacuacugcgccaaggacaugagagaguacgagugcgaggagugggccagcgacuacuacgacuucggcagagaccagcccugccaggaccccagaggcguggugggcaccuucgacaucuggggccagggcaccaugguggccgugagcagc

SEQ ID NO: 32618 - RNA, 432 nt, Artificial Sequence
  derived and/or modified sequence opt4 from anti-HIV_cap256-059-063270_VR-Chain
caggugcagcugguggagagcggcggcggcguggugcagcccggcagaagccugagacugagcugcgccgccagccaguucaccuucagcaacuacggcaugcacugggugagacaggcccccggcaagggccuggaguggguggccgccaucagcuucgccggcaccaagaagcacuacgccgacagcgugaagggcagauucaccaucagcagagacaacagcaagaacgcccuguaccugcagaugaacagccugagagccgaggacaccgcccuguacuacugcgccaaggaccugagagaguacgagugcgaggagugggccagcgacuacuacgacuucggcagagaccagcccugccuggaccccagaggcguggugggcaucuucgacaucuggggccagggcacccuggugaccgugagcagc

SEQ ID NO: 32619 - RNA, 432 nt, Artificial Sequence
  derived and/or modified sequence opt4 from anti-HIV_cap256-059-061357_VR-Chain
caggugcagcugguggagagcggcggcggcguggugcagcccggcagaagccugagacugagcugcgccgccagcggcuucaccuucagcaacuucggcuuccacugggugagacaggcccccggcaagggccuggaguggguggccggcaucagcuucgccggcaccaagaucuacuacgccgacagcgugaagggcagauucaccaucagcagagagaacagcaagaacaugcuguaccugcagaugaacagccugagaggcgaggacaccgccguguacuucugcgccaaggaccugagagaguucgagugcgaggagugggccagcgacuacuacgacuucggcagagaguuccccugccaggaccccagaggcguggugggcaccuucgacguguggggccacggcgccguggugaccgugagcagc

SEQ ID NO: 32620 - RNA, 435 nt, Artificial Sequence
  derived and/or modified sequence opt4 from anti-HIV_cap256-059-059834_VR-Chain
caggugcagcugguggagagcggcggcggcguggugcagcccggcagaagccugagacugagcugcgccgccagcggcuucaccuucagcaacuucggcaugcacugggugagacaggcccccggcaagggccuggaguggguggccuucguggccuucgacgagagcgacaaguacuacgccgccagcgugaagggcagauucaccgugagcagagacaacagcaagaacaccgugagccugcagaugaacagccugagaaccgaggacaccgccguguacuacugcgccaaggaggugggcgacaacaaggacgacgaguggaccagccccuacuacuacgacuucagcaucgccuaccccgugcacgaccccagagccguggugggcggcuacgacguguggggccagggcaccauggugaccgugagcagc

SEQ ID NO: 32621 - RNA, 432 nt, Artificial Sequence
  derived and/or modified sequence opt4 from anti-HIV_cap256-059-059313_VR-Chain
caggugcaccugguggagagcggcggcggcguggugcagcccggcaagagccugagacugagcugcgccgccagccaguucaccuucagcaacuucggcaugcacugggugagacaggcccccggcaagggccuggaguggguggccggcaucagcuucgccggcaccaagaaguacuacgccgacagcgugaagggcagauucaccaucagcagagacaacagcaagaacacccuguaccugcagaugaacagcgugagagccgaggacaccgcccuguacuacugcgccaaggacaugagagaguacgagugcgaggagugggccagcgacuacuacgacuucggcaagccccagcccugccaggaccccagaggcguggugggcaccuucgacauguggggccugggcacccuggugaccgugagcagc

SEQ ID NO: 32622 - RNA, 432 nt, Artificial Sequence
  derived and/or modified sequence opt4 from anti-HIV_cap256-059-057130_VR-Chain
caggugcagcugguggagagcggcggcggcguggugcagcccggcagaagccugagacugagcugcgccgccagccaguucagcuucagcagcuacggcaugcacugggugagacaggcccccggcaagggccuggaguggguggccgccaucagcuucgccggcaucaagaagcacuacgccgacagcgugaagggcagauucaccaucagcagagacaacagcaagaacacccuguaccugcagaugaacagccugagaguggaggacaccgcccuguacuacugcgccaaggaccugagagaguacgagugcgaggagugggccagcgacuacuacgacuucggcagaccccagcccugccaggaccccagaggcguggugggcaccagcgacaucuggggccagggcaccauggugaccgugagcagc

SEQ ID NO: 32623 - RNA, 411 nt, Artificial Sequence
  derived and/or modified sequence opt4 from anti-HIV_cap256-059-050520_VR-Chain
caggugcagcugguggagagcggcggcggcguggugcagcccggcagaagccugagacugagcugcgccgccagccaguucaccuucaacagauacggcaugcacugggugagacaggcccccggcaagggccuggaguggguggccgugaucagcuacgccgacagcgugaagggcagauucaccaucagcagagacaacagcaagaacacccuguaccugcagaugaacagccugagagccgaggacaccgcccuguacuacugcgccaaggaccugagagaggacgagugcgaggagugguggagcgacuacuacgacuucggcagagagcugcccugcagaaagagcagaggcguggccggcaucuucgacaucuggggccagggcaccauggugaccgugagcagc

SEQ ID NO: 32624 - RNA, 432 nt, Artificial Sequence
  derived and/or modified sequence opt4 from anti-HIV_cap256-059-049839_VR-Chain
caggugcagcugguggagagcggcggcggcguggugcagcccggcagaagccugagacugagcugcgccgccagcggcuucagcuucagcaacuacgccauggacugggugagacaggcccccggcaagggccuggaguggguggccguggugagcagcgacggcaagaccaagaacuacgccgacagcgugaagggcagauucaccaucagcagagacaacagcaagaacaccguguaccugcagaugaacagccugagacccgaggacaccgccguguacuacugcgccaaggaccugggcgccaacaaggacgacgaguggaccaccgacuacuacgacuggagcguggccuaccccgugcccgaccccagagccguggugggcgccuucgacguguggggccagggcaccauggugaccgugagcagc

SEQ ID NO: 32625 - RNA, 432 nt, Artificial Sequence
  derived and/or modified sequence opt4 from anti-HIV_cap256-059-048503_VR-Chain
caggugcagcugguggagagcggcggcggcguggugcagcccggcagaagccugagacugagcugcgccgccagccagcugagcuucagcaacuacggcaugcacugggugagacaggcccccggcaagggccuggaguggguggccggcaccagcuucgccggcaccaagaaguacuacgccgacagcgugaagggcagauucaccaucagcagagacaacagcaagaacgcccuguaccugcagaugaacagccugagagccgaggacaccgcccuguacuacugcgccaaggaccugagagaguacgagugcgaggagugggccagcgacuacuacgacuucggcagagaccagcccugccaggaccccagaggcguggugggcaccuucgacaucuggggccagggcaccauggugaccgugagcgcc

SEQ ID NO: 32626 - RNA, 432 nt, Artificial Sequence
  derived and/or modified sequence opt4 from anti-HIV_cap256-059-045516_VR-Chain
caggugcagcugguggagagcggcggcggcguggugcagcccggcagaagccugagacugagcugcgccgccagccaguucaccuucagcggcuacggcaugcacugggugagacaggcccccggcaagggccuggaguggguggccgccaucagcuucgccggcaacaagagauacuucgccgacagcgugaagggcagauucaccaucagcagagacaacagcaagaacacccuguuccugcagaugaacagccugagagccgaggacaccgcccuguacuacugcgccagagacaugagagaguacgagugcgaggagugggccagcgacuacuacgacuucggcagaccccagcccugccaggaccccagaggcguggugggcguguucgacaucuggggccagggcaccauggugaccgugagcagc

SEQ ID NO: 32627 - RNA, 432 nt, Artificial Sequence
  derived and/or modified sequence opt4 from anti-HIV_cap256-059-044188_VR-Chain
caggugcaccugguggagagcggcggcggcguggugcagcccggcagaagccugagacugagcugcgccgccagccaguucaccuucagcagcuacggcaugcacugggugagacaggcccccggcaagggccuggaguggguggccggcaucagcuucgccggcaccaacaaguacuacgccgacagcgugaagggcagauucaccgugagcagagacaacagcaagaacacccuguacgugcagaugaacagccugagagccgaggacaccgcccuguacuacugcgccagagaccugagagaguacgagugcgaggagugggccagcgacuacuacgacuucggcagagagcagcccugccaggaccccagaggcguggugggcaucuucgacaucuggggccccggcaccauggugaccgugagcagc

SEQ ID NO: 32628 - RNA, 435 nt, Artificial Sequence
  derived and/or modified sequence opt4 from anti-HIV_cap256-059-044105_VR-Chain
cagggccagcugguggagagcggcggcggcguggugcagcccggcagaagccugagccugagcugcgccgccagcggcuucagcuucaacaacuacgccauggacugggugagacaggcccccggcaagggccuggaguggguggccguggugagcagcgacggcaacaacaagaacuacgccgacagcgugaagggcagauucaccaucagcagagacaacagcaagaacaccguguaccugcagaugaacagccugagagccgaggacaccgccaucuacuacugcgccaaggacgugggcgccaacaaggacgacgagugggccaccaacuacuacuacgacuggagcguggccuaccccgugcccgaccccagagccgugaucggcgccuucgacguguggggccagggcaccauggugaccgugagcagc

SEQ ID NO: 32629 - RNA, 432 nt, Artificial Sequence
  derived and/or modified sequence opt4 from anti-HIV_cap256-059-042100_VR-Chain
caggugcagcugguggagagcggcggcggcguggugcagcccggcagaagccagagacugagcugcgccgccagccaguucaccuucagcagcuacggcaugcacugggugagacaggcccccggcaagggccuggaguggguggccgccaucagcuucgccggcaccaacaaguacuacggcgacagcgugaagggcagauucaccaucagcagagacaacagcaagaacacccuguaccugcagaugaacagccugagagccgaggacaccgcccuguaccacugcgccagagacaugagagaguacgagugcgaggagugggccagcgacuacuacgacuucggcagagaccagcccugccaggaccccagaggcguggugggcaucuucgaccuguggggccagggcaccauggugaccgugagcagc

SEQ ID NO: 32630 - RNA, 432 nt, Artificial Sequence
  derived and/or modified sequence opt4 from anti-HIV_cap256-059-040742_VR-Chain
caggugcagcugguggagaccggcggcggcgugggccagcccggcaagagccugagacugagcugcgccgccagcggcuucaccuucagcaacuucgccauggacugggugagacaggcccccggcaagggccuggaguggguggccuucaucagcagcgacggcaucaacaagaaguacggcgacuucgugaagggcagauucaccaucagcagagacaacagcaagaacacccuguuccugcagaugaacagccugagagccgaggacaccgcccuguacuacugcgccaaggacgugggcgacuacaagagcgacgaguggggcaccgacuacuacgaccugagcaucgaguaccccauccaggaccccagagccguggugggcgccuucgacaacuggggccagggcaccauggugaucgugagcagc

SEQ ID NO: 32631 - RNA, 432 nt, Artificial Sequence
  derived and/or modified sequence opt4 from anti-HIV_cap256-059-040554_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccggcaucagcuucgccgccaccaacaaguacuacggcggcagcgugaagggcagauucaccaucagcagagacaacagcaagaacacccuguaccugcagaugaacagccugagagccgaggacaccgcccuguacuacugcaccagagacaugagagaguacgagugcgaggagugggccagcgacuacuacgacuucggcaaggaccagcccugccaggaccccagaggcguggugggcacccuggacaucuggggccagggcaccauggugaccgugagcagc

SEQ ID NO: 32632 - RNA, 432 nt, Artificial Sequence
  derived and/or modified sequence opt4 from anti-HIV_cap256-059-039660_VR-Chain
caggugcagcugguggagagcggcggcggcguggugcagcccggcagaagccugagacugagcugcgccgccagccaguucagcuucagcaacuacggcaugcacugggugagacaggcccccggcaagggccuggaguggguggccagcaucagcuucgccggcaccaagaagaaguacgccgacagcgugaagggcagauucaccaucagcagagacaacagcaagaacacccuguuccugcagaugaacagccugagaaccgaggacgccgcccuguacuacugcgccaaggacaugagagaguucgagugcgaggagugggccagcgacuacuacgacuucggcagagagcagcccugccaggacaccagagacguggugggcaucuucgacaucuggggccagggcaccauggugaccgugagcagc

SEQ ID NO: 32633 - RNA, 435 nt, Artificial Sequence
  derived and/or modified sequence opt4 from anti-HIV_cap256-059-039298_VR-Chain
caggugcagcugguggagagcggcggcggcguggugcagcccggcagaagccugagacugagcugcgccgccagcggcuucaccuucagcaaguacggcaugcacugggugagacaggcccccggcaagggccuggaguggguggccuucguggccuucgacgagagcgacaaguacuacgccgccagcgccaagggcagauucaucaucagcagagacaacagcaagaacacccugagccugcagaugaacagccugagaaccgaggacaccgccguguacuacugcgccaaggaggugggcgacaacaaggacgacgaguggaccagccccuacuacuacgacaucagcaucgccuaccccgugcaggaccccagagccguggugggcggcuacgacguguggggccagggcaccauggugaccgugagcagc

SEQ ID NO: 32634 - RNA, 432 nt, Artificial Sequence
  derived and/or modified sequence opt4 from anti-HIV_cap256-059-037873_VR-Chain
caggugcagcugguggagagcggcggcggcguggugcagcccggcagaagccugagacugagcugcgccgccagccaguucaccuucagcaacuacggcaugcacugggugagacaggcccccggcaagggccuggaguggguggccgccaucagcuucgccggcaucaacaaguacuacgccgacagcgugaagggcagauucacccugagcagagacaacaccaagaacacccuguaccugcagaugaacagccugagagccgaggacaccgcccuguacuacugcgccagagaccugagagaguacgagugcgaggagugggccagcgacuacuacgacuucggcagaccccagcccugccaggaccccagaggcguggugggcaccagcgacaucuggggccagggcaccauggugaccgugagcagc

SEQ ID NO: 32635 - RNA, 432 nt, Artificial Sequence
  derived and/or modified sequence opt4 from anti-HIV_cap256-059-037633_VR-Chain
caggugcagcugguggagagcggcggcggcguggugcagcccggcagaagccugagacugagcugcgccgccagccaguucaccuucagcaacuucggcaugcacugggugagacaggcccccggcaagggccuggaguggguggccgccaucagcuucgccggcaucaacaagaacuacgccgacagcgugaagggcagauucaccaucagcagagacaacagcaagaacacccugcaccugcagcugaacagccugagagccgaggacaccgcccuguacuacugcgccaaggaccugagagaguacgagugcgaggagugggccagcgacuacuacgacuucggcagagaccagcccugccaggaccccagaggcguggugggcaccuucgacaucuggggccagggcaccauggugaccgugagcagc

SEQ ID NO: 32636 - RNA, 432 nt, Artificial Sequence
  derived and/or modified sequence opt4 from anti-HIV_cap256-059-036817_VR-Chain
caggugcagcugcuggagagcggcggcggcguggugcagcccggcagaagccugagacugagcugcgaggccagccaguucaccuucagcaacuucggcaugcacugggugagacaggcccccggcaagggccuggaguggguggccgccaucagcuucgccggcaucaagaagaacuacgccgacagcgugaagggcagauucaccaucagcagagacaacagcaagaacacccuguaccugcagaugaacagccugagaguggaggacaccgcccuguacuacugcgccaaggaccugagagaguacgagugcgaggagugggccagcgacuacuacgacuucggcagagagcagcccugccaggaccccagaggcgugaucggcaccuucgacaucuggggccagggcaccauggugaccgugagcagc

SEQ ID NO: 32637 - RNA, 432 nt, Artificial Sequence
  derived and/or modified sequence opt4 from anti-HIV_cap256-059-032787_VR-Chain
caggugcagcugguggagagcggcggcggcguggugcagcccggcagaagccugagacugagcugcgccgccagcggcuucaccuucagcaaguacgccaugcacugggugagacaggcccccggcaagggccuggaguggguggccuucguggccuucgacgagagcgacaaguacuacguggacagcgugaagggcagauucaccaucagcagagacaacagcaagaacacccugagccugcagaugaacagccugagagccgaggacaccgccguguacuacugcgccaaggaggugcacgugaacaaggacgacgagugggccagcgacuacuacgaccugagcaucgccuaccccauccaggaccccagagccguggugggcggccuggacaucuggggccagggcaccauggugaccgugagcagc

SEQ ID NO: 32638 - RNA, 432 nt, Artificial Sequence
  derived and/or modified sequence opt4 from anti-HIV_cap256-059-032427_VR-Chain
caggugcagcugguggagagcggcggcggcguggugcagcccggcagaagccugagacugagcugcgccgccagccaguucaccuucagcaacuucggcaugcacugggugagacaggcccccggcaagggccuggaguggguggccggcaucagcuuccccggcaccaagaaguacuacgccgacagcgugaagggcagauucaccaucagcagagacaacagcaagaacgcccuguaccugcagaugaacagccugagagccgaggacaccgcccuguacuacugcgccagagaccugagagaguacgagugcgaggagugggccagcgacuacuacgacuucggcaagccccagcccugccuggaccccagaggcguggugggcaccuucgacaucuggggccagggcaccauggugaccgugagcagc

SEQ ID NO: 32639 - RNA, 435 nt, Artificial Sequence
  derived and/or modified sequence opt4 from anti-HIV_cap256-059-029390_VR-Chain
caggugcagcugguggagagcggcggcggcguggugcagcccggcagaagccugagacugagcugcgccgccagcggcuucaccuucaaccagcacggcaugcacugggugagacaggcccccgacaagggccuggaguggguggccuucgugggcuucgacgagagcgagaaguacuacgccgacagcgugaagggcagauucaccaucagcagagacaacagcaagaacacccugagccugcagaugaacagccugagacccgaggacaccgccguguacuacugcgccaaggaggugggcgacaacaaggaggacgagugggccagcgacuacuacuacgaccugagcaacgccuaccccauccacgaccccagagccguggugggcggcuacgacaucuggggccagggcaccauggugaccgugugcagc

SEQ ID NO: 32640 - RNA, 435 nt, Artificial Sequence
  derived and/or modified sequence opt4 from anti-HIV_cap256-059-027877_VR-Chain
caggugcagcugguggagagcggcggcggcguggugcagcccggcagaagccugagacugagcugcagcgccagcgccuucagcuucagcuacuucgccauggacugggugagacaggcccccggcaagggccuggaguggguggccuucgugagcagcgacggcaacaacaagaacuacgccgacagcgugaagggcagauucaccaucagcagagacaacagcaagaacaccguguuccugcagauggacagccugagacccgaggacaccgccguguacuacugcgccaaggaccugggcggcaacaaggacgacgaguggagcaccaacuacuacuacgacaucagcaucgccgaccccgugcccgaccccagagccguggccggcgccuucgacguguggggccagggcaccauggugaccgugagcagc

SEQ ID NO: 32641 - RNA, 435 nt, Artificial Sequence
  derived and/or modified sequence opt4 from anti-HIV_cap256-059-026640_VR-Chain
caggugcagcugguggagagcggcggcggcguggugcagcccggcagaagccugagacugagcugcgccgccagcggcuucagcuucagcaaguacggcaugcacugggugagacaggcccccggcaagggccuggaguggguggccuucguggccuucgacgagagcgacagauacuacgccgccagcgugaagggcagauucaccaucagcagagacaacagcaagaacacccugagccugcagaugaacagccugagaaccgaggacaccgccaucuacuacugcgccaaggaggugggcgacaacaaggacgacgaguggaccagccccuacuacuacgacaugagcaucgccuaccccgugcaggaccccagagccguggugggcggcuacgacaucuggggccagggcaccauggugaccgugagcagc

SEQ ID NO: 32642 - RNA, 432 nt, Artificial Sequence
  derived and/or modified sequence opt4 from anti-HIV_cap256-059-026017_VR-Chain
caggugcagcugguggagagcggcggcggcguggugcagcccggcagaagccugagacugagcugcgccgccagcggcuucaccuucagcaccuacgccaugcacugggugagacaggcccccggcaagggccuggaguggguggcccugaucagcuacgacggcaccaacaaguacuacguggacagcgccaagggcagauucaccaucagcagagacaacagcaagaacacccuguaccugcagaugaacagccugacccccgaggacaccgccguguucuacugcgccaaggaccugggcggcuacaaggacgacgaguggggcaccgaguacuacgacaucagcgugagcuaccccgugcaggaccccagagccguggccggcguguucgacguguggggccacggcaccauggugaccgugagcagc

SEQ ID NO: 32643 - RNA, 432 nt, Artificial Sequence
  derived and/or modified sequence opt4 from anti-HIV_cap256-059-024100_VR-Chain
ugccaggugcugguggagagcggcggcggcguggugcagcccggcagaagccugagacugagcugcgccgccagccaguucaccuucagcagcuacggcaugcacugggugagacaggcccccggcaagggccuggaguggguggccgccaucagcuucgccggcaccaagaaguacuacgccgacagcgugaagggcagauucgccaucagcagagacaccagcaagaacgcccuguaccugcagaugaacacccugagagccgaggacaccgcccuguacuacugcgccagagaccugagagaguucgagugcgaggagugggccagcgacuacuacgacuucggcagaccccagcccugccaggaccccagaggcguggugggcagcuucgacaucuggggccagggcaccauggugaccgugagccug

SEQ ID NO: 32644 - RNA, 432 nt, Artificial Sequence
  derived and/or modified sequence opt4 from anti-HIV_cap256-059-023966_VR-Chain
caggugcagcugguggagagcggcggcggcguggugcagcccggcagaagccugagacugagcugcgccgccagccaguucagcuucagcagcuacggcaugcacugggugagacaggcccccggcaagggccuggaguggguggccgccaucagcuucgccggcaucaagaagcacuacaccgacagcgugaagggcagauucaccaucagcagagacaacagcaagaacacccuguaccugcagaugaacagccugagagccgaggacaccgcccuguacuacugcgccaaggaccugagaggcuucgagugcgaggagugggccagcgacuacuacgacuucggcagagaccagcccugccaggaccccagaggcguggugggcaccuucgacaucuggggccagggcacccuggugaccgugagcagc

SEQ ID NO: 32645 - RNA, 432 nt, Artificial Sequence
  derived and/or modified sequence opt4 from anti-HIV_cap256-059-020534_VR-Chain
caggugcagcugguggagagcggcggcggcguggugcagcccggcagaagccugagacugagcugcgccgccagccaguucaccuucagcaacuacggcaugcacugggugagacaggcccccggcaagggccuggaguggguggccggcaugagcuucgccggcaccaacaccuacuacgccgacagcgugaagggcagauucaccaucagcagagacaacagcaagaacacccuguaccugcagaugaacagccugagagccguggacaccgcccuguacuacugcgccagagacaugagagaguacgagugcgaggagugggccagcgacuacuacgacuucggcagagaguaccccugccaggaccccagaggcguggugggcaucuucgaccuguggggccagggcaccauggugaccgugagcagc

SEQ ID NO: 32646 - RNA, 435 nt, Artificial Sequence
  derived and/or modified sequence opt4 from anti-HIV_cap256-059-019513_VR-Chain
caggugcagcugguggagagcggcggcggcguggugcagcccggcagaagccugagacugagcugcgccgccagcggcuucaccuucagcaacuucgccaugggcugggugagacaggcccccggcaagggccuggaguggguggccgugaucagcagcgacggcaccaacaagaacuacggcgacagcgugaagggcagauucaccaucagcagagacaacagcaagaacacccuguuccugcagaugaacagccugagagccgaggacaccagccuguacuacugcgccaaggaccugggcggcuacaagaccgacgagugggccaccaacuacuacuacgacaucagcaucgccagccccauccaggaccccagagccguggugggcgccuucgacaucuggggccagggcaccauggugaccgugaccagc

SEQ ID NO: 32647 - RNA, 432 nt, Artificial Sequence
  derived and/or modified sequence opt4 from anti-HIV_cap256-059-012963_VR-Chain
caggugcagcugguggagagcggcggcggcguggugcagcccggcagaagccugagacugagcugcguggccagcggcuucagcuucagcagcuacggcauggccugggugagacaggcccccggcaagggccuggagugggugaccgugaucagcuucgccggcgugaagaccuacuacgccgacagcgugaagggcagauucaccaucagcagagacaacagcaagggcacccuguaccugcagauggacggccugagacccgaggacaccgcccuguacuacugcgccaaggaccuggccgagagagagugcgaggagugggccagcgacuacuacgacuucggcagagagcugcccugccaggaccccagaggcguggugggcaccuucgacguguggggccagggcaccauggugaccgugagcagc

SEQ ID NO: 32648 - RNA, 435 nt, Artificial Sequence
  derived and/or modified sequence opt4 from anti-HIV_cap256-059-010396_VR-Chain
caggugcagcugguggagagcggcggcggcguggugcagcccggcagaagccugagacugagcugcgccgccagcggcuucagcuucaacaacuacgccaugaacugggugagacaggcccccggcaagggccuggaguggguggccuucgugagcagcgacggcagcaacaagaacuacgccgacagcgugaccggcagauucacccugagcagagacaacagcaagaacaccguguuccugcagaugaacagccugagaguggaggacaccgccguguacuacugcgccaaggacgugggcgccaacaaggacgacgaguggaccaccaacuacuacuacgacaucagcaucgccgaccccgugcccgaccccagagccgugaucggcgccuucgacguguggggccagggcaccauggugaccgugagcagc

SEQ ID NO: 32649 - RNA, 432 nt, Artificial Sequence
  derived and/or modified sequence opt4 from anti-HIV_cap256-059-008136_VR-Chain
caggugcagcugguggagagcggcggcggcguggugcagcccggcagaagccugagacugagcugcgccgccagcggcuucaccuucaacaccuacgccaugcacugggugagacaggcccccggcaagggccuggaguggguggcccugaucagcuacgacggcaccgagaaguacuacgccgacagcgugaagggcagauucaccaucagcagagacaacagcagaaacacccuguaccugcagaugaacagccugagacuggaggacgccgcccuguaccagugcgccaaggaccugggcggcagcaagagcgacgaguggggcaccgacuacuacgacaugagcaucagcuaccccauccaggaccccagagccguggccggcguguucgacaucuggggccagggcacccuggugaccgugagcagc

SEQ ID NO: 32650 - RNA, 432 nt, Artificial Sequence
  derived and/or modified sequence opt4 from anti-HIV_cap256-059-006147_VR-Chain
caggugcaggugguggagagcggcggcggcguggugcagcccggcagaagccugagacugagcugcaccgccagcggcuucaccuucagcaacuucgccaugggcugggugagacaggcccccggcaagggccuggaguggguggccuucaucagcagcgacggcagcaacaagaacuacggcgacagcgugaagggcagauucaccaucagcagagacaacagcaagaacaccguguuccugcagaugaacagccugagaguggaggacaccgcccuguacuacugcgccaaggacgugggcgacuacaagagcgacgaguggggcaccgaguacuacgacaucagcaucagcuaccccauccaggaccccagagccauggugggcgccuucgaccuguggggccagggcaccauggugaccgugagcccc

SEQ ID NO: 32651 - RNA, 432 nt, Artificial Sequence
  derived and/or modified sequence opt4 from anti-HIV_cap256-059-005081_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccggcaucagcuucgccgccaccaagaaguacuacagcgagagcgugaagggcagauucaccaucagcagagacaacagcaagaacgcccugcaccugcacaugaacagccugagagccgaggacaccgcccuguacuacugcgccaaggaccugagagaguucgagugcgaggagugggccagcgacuacuacgacuucggcagagaccagcccugccaggaccccagaggcguggugggcaucuucgacauguggggccagggcaccauggugaccgugagcagc

SEQ ID NO: 32652 - RNA, 432 nt, Artificial Sequence
  derived and/or modified sequence opt4 from anti-HIV_cap256-059-005006_VR-Chain
caggcccagcugguggagagcggcggcggcguggugcagcccgccaagagccugagacugagcugcgccgccagcggcuucaccuucaacaaguacgccaugcacugggugagacaggcccccggcaagggccuggaguggguggccuucguggccuucgacgagagcgacaaguacuacgccgacagcgugaagggcagauucaccaucagcagagacaacagcaagaacacccugagccugcagaugaacaaccugagagccgaggacaccgccguguacuacugcgccaaggaggugggcgacaacaaggacgacgagugggccagcgacuacuacgaccugagcaucgccuaccccauccaggaccccagagccgugggcagaggcuacgacaucuggggccagggcaccauggugaccgugagcagc

SEQ ID NO: 32653 - RNA, 432 nt, Artificial Sequence
  derived and/or modified sequence opt4 from anti-HIV_cap256-059-004451_VR-Chain
caggugcaccugguggagagcggcggcggcguggugcagcccggcaagagccugagacugagcugcaccgccagcggcuucaccuucaccaacuucgccauggacugggugagacaggcccccggcaagggccuggaguggguggccuucaucagcagcgacggcagcaacaaguacuacagcgagagcgugaagggcagauucaccaucagcagagacaacagcaagaacacccuguacgugcagaugaacagccugagaaccgaggacaccgccguguacuacugcgccaaggaccugggcggcuacaaggacgacgaguggagcaccgacuacuacgacuggagcaccgccuaccccgugcaggaccccagagccguggccggcgccuucgaccuguggggccagggcaccauggugagcgugagcagc

SEQ ID NO: 32654 - RNA, 432 nt, Artificial Sequence
  derived and/or modified sequence opt4 from anti-HIV_cap256-059-003571_VR-Chain
caggagcagcugguggagagcggcggcggcguggugcagcccggcagaagccugagacugagcugcgccgccagccaguucaccuucggcgccuacggcaugcacugggugagacaggcccccggcaagggccuggaguggguggccggcgugagcuucgugggcaacaacaaguacuacgccgacagcgugaagggcagauucaccaucagcagagacaacagcaagaacacccuguaccugcagaugaacagccugagaggcgaggacaccgcccuguacuacugcgccagagacaugagagagauggagugcgaggagugggccagcgacuacuacgacuucggcagaccccagcccugccaggaccccagaggcguggugggcaucuucgacauguggggccagggcaccauggugaccgugagcagc

SEQ ID NO: 32655 - RNA, 432 nt, Artificial Sequence
  derived and/or modified sequence opt4 from anti-HIV_cap256-059-003449_VR-Chain
caggugcagcugguggagagcggcggcggcguggugcagcccggcaagagccugagacugagcugcgccgccagccaggugaccuucagcagcuacggcaugcacugggugagacaggcccccggcaagggccuggaguggguggccggcaucagcuucgccggcaccaagaaguacuacgccgacagcgugaagggcagauucaccaucagcagagacaacagcaagaacgcccuguaccugcagaugaacagacugagagccggcgacaccgcccuguacuacugcgccaaggaccugagagaguacgagugcgaggagugggccagcgacuacuacgacuucggcagagagcagcccugccaggaccccagaggcguggugggcaucuucgacaucuggggccugggcaccauggugaccgugagcagc

SEQ ID NO: 32656 - RNA, 432 nt, Artificial Sequence
  derived and/or modified sequence opt4 from anti-HIV_cap256-059-002712_VR-Chain
caggugcagcuggccgagagcggcggcggcguggugcagcccggcagaagccugagacugagcugcgccgccagccaguucaccuucagcagcuacggcaugcacugggugagacaggcccccggcaagggccuggaguggguggccgccaucagcuucgccggcaccaagaagcacuacgccgacagcgugaagggcagauucaccaucagcagagacaacagcaagaacacccugaaccugcagaugaacagccugagagccgaggacaccgcccuguacuacugcgccagagacaugagagaguacgagugcgaggugugggccagcgacuacuacgacuucggcagagagcagcccugccaggaccccagaggcguggugggcaccuucgacaucuggggccagggcaccauggugaccgugagcccc

SEQ ID NO: 32657 - RNA, 432 nt, Artificial Sequence
  derived and/or modified sequence opt4 from anti-HIV_cap256-059-001573_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccggcaucagcuacgacggcaccagcaaguacuacgccgacagcgugaagggcagauucaccaucagcagagacaacagcaagaacacccuguaccugcagaugaacagccugagagccgaggacaccgcccuguacuacugcgccaaggaccugagagaggacgagugcgaggagugguggagcgacuacuacgacuucggcagagagcugcccugcagaaagagcagaggcguggccggcaccuucgacaucuggggccacggcaccauggugaccgugagcagc

SEQ ID NO: 32658 - RNA, 432 nt, Artificial Sequence
  derived and/or modified sequence opt4 from anti-HIV_cap256-059-001379_VR-Chain
caggugagacugguggagagcggcggcggcguggugcagcccggcagaagccugagacugagcugcgccgccagcggcuucaccuucaacagcuaccccaugcacugggugagacaggcccccggcaagggccuggacuggguggcccugaucagcuacgacggcaccaacaaguucuacguggacagcgugaagggcagauucaccaucagcagagacaacagcaagaacacccuguaccugcagaugaacagccugaccgccgaggacaccgccauguacuacugcgccaaggaccugggcggcaacaaggacgacgaguggggcaccgacuacuacgacaucagcguggccuaccccauccacgaccccagagccguggccggcaucuucgacguguggggccacggcaccauggugaccgugagcagc

SEQ ID NO: 32659 - RNA, 432 nt, Artificial Sequence
  derived and/or modified sequence opt4 from anti-HIV_cap256-059-001029_VR-Chain
caggagcagcuggugcagagcggcggcggcguggugcagcccggcagaagccugagacugagcugcgcccccagccaguucaccuucagcgcccacggcaugcacugggugagacaggcccccggcaagggccuggaguggguggccggcaucagcuucgccggcaccaagaacuacuacgccgacagcgugaagggcagauucaccaucagcagagacaacagcaagaacacccuguaccugcagaugaacagccugagaguggaggacaccgcccuguacuacugcgccaaggacaugagagagauggagugcgaggagugggccagcgacuacuacgacuucggcagacaccagcccugccaggaccccagaggcguggugggcaucuucgacaucuggggccagggcaccauggugaccgugagcagc

SEQ ID NO: 32660 - RNA, 432 nt, Artificial Sequence
  derived and/or modified sequence opt4 from anti-HIV_cap256-048-165087_VR-Chain
gaggugaagcugcuggagagcggcggcggccuggugcagcccggcggcuacagaagacugagcugcgccgccagcggcuucaccuucagcagauacgccaugcacugggccagacaggcccccggcaagggccuggaguggguggccguggugagcgacgacggcgugaagaaguacuaccccgacagcgugagaggcagauucaccaucagcagagacaacagcagaaacaccgugagccugcagaugaacagccugagacccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32661 - RNA, 432 nt, Artificial Sequence
  derived and/or modified sequence opt4 from anti-HIV_cap256-048-158861_VR-Chain
gaggugcagcugguggagagcggcggcggccuggugcagcccggcggcagccugagacugagcugcguggacuucggcuucagauucagcgaguacuggaugagcugggugagacaggcccccggcaagggccuggaguggguggccgugaucagcuacgacggcaccaacaaguacuacgccgacagcgugaagggcagauucaccaucagcagagacaacagcaagaacacccuguaccugcagaugaacagccugagagccgaggacaccgcccuguacuacugcgccaaggacaugagagagagcgagugcgaggagugggccagcgacuacuacgacuucggcaaggacuaccccugccaggaccccagaggcguggugggcaccuucgacaucuggggccagggcaccauggugaccgugagcagc

SEQ ID NO: 32662 - RNA, 435 nt, Artificial Sequence
  derived and/or modified sequence opt4 from anti-HIV_cap256-048-158280_VR-Chain
caggugcaccugguggagagcggcggcggcguggugcagcccggcagaagccugagaaucuacugcgccgugagcgaguucaccuucagaaacuacgccaugcacugggugagacuggcccccggcaagggccugcaguggguggccgugaucagccacgacggcaucaacgacuacuacgccgacagcgugaagggcagauucaccaucagcagagacaacagcaagaacaccgugagccugcagaugaacagccugagacccgaggacaccgccguguacuacugcgccaaggaccugggcgccaacaaggacgacgagugggccaccgacuacuacgaccugagcaucgccuaccccgugcccgaccccaccggccccugguucggcgccuucgacaucuggggccagggcaccauggugaccgugagcagc

SEQ ID NO: 32663 - RNA, 432 nt, Artificial Sequence
  derived and/or modified sequence opt4 from anti-HIV_cap256-048-157928_VR-Chain
caggugcagcugauggagagcggcggcggcguggugcagcccggcagaagccugagacugagcugcgccaucagcggcuucaccuucagcaacuacuggaugagcugggugagacaggcccccggcaagggccuggaguggguggccgugaucagcagcgacggcagcagcaagaacuacgccgacagcgugaagggcagauucaccaucagcagagacaacagcaagaacaccgugagccugcagaugaacagccugagacccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32664 - RNA, 432 nt, Artificial Sequence
  derived and/or modified sequence opt4 from anti-HIV_cap256-048-157056_VR-Chain
caggugcagcugguggagagcggcggcggcguggugcagcccggcagaagccugagacugagcugcgccgccagcggcuucacccugagcagcuacgccaugcacugggugagacaggcccccggcaagggccuggaguggguggccuucaucagcaacgacggcagcaacaaguacuucgccgacagcgugaagggcagauucaccaucagcagagacaacagcaagaacacccuguaccugcagaugaacagccugagagccgaggacaccgccguguacuacugcgccaaggaccugggcggcaacaaggacgacgagugggccaccgacuacuacgaccugagcaucgccuaccccgugcaggaccccagagugguggugggcaucuucgacaucuggggccagggcaccauggugaccgugagcagc

SEQ ID NO: 32665 - RNA, 432 nt, Artificial Sequence
  derived and/or modified sequence opt4 from anti-HIV_cap256-048-156422_VR-Chain
caggugcagcugguggagagcggcggcaccguggugcagcccggcagaagccugagacugagcugcgugggcagcggcuucagccugagcuacuacgccauccacugggugagacaggcccccggcaagggccuggaguggguggccgugaucagcuacgacggcagcaacuacuacuacgccgacagcgugaagggcagauucaccaucagcagagacaacagcaagaacaccguguaccugcagaugaacagccugagaggcguggacaccgccguguacuacugcgccaaggaccugggcggcggcgagguggaggagugggccaccgacuacuacgacuggagcaucgccuaccccguggagcaccccagagccguggugggcguguucgacaucuggggccagggcaccaaggugaccgugagcagc

SEQ ID NO: 32666 - RNA, 432 nt, Artificial Sequence
  derived and/or modified sequence opt4 from anti-HIV_cap256-048-152863_VR-Chain
gaggugcagcugcuggagagcggcggcggccuggugcagcccggcggcagccugagacugagcugcgccggcagcggcuucaccuucagcaagcacggcaugcacugggugagacaggcccccggcaagggccuggaguggguggccuucguggccuucgacgagagcgacaaguacuacgccgacagcgugaagggcagauucaccaucagcagagacaacagcaagaacacccugagccugcagaugaacagccugagagccgaggacaccgccauguacuacugcgccaaggaggugggcgacaacaaggacgacgagugggccagcgacuacuacgaccugagcaucgccuaccccgugcacgaccccagagccguggugggcggcuacgacaucuggggccagggcaccauggugaccgugagcagc

SEQ ID NO: 32667 - RNA, 432 nt, Artificial Sequence
  derived and/or modified sequence opt4 from anti-HIV_cap256-048-152770_VR-Chain
caggugcagcugguggagagcggcggcggcguggugcagcccggcagaagccugagacugagcugcgccgccagcggcuucaccuucagaagcaacgccaugcacugggugagacaggcccccggcaagggccuggaguggguggccgugaucagcuacgacggcagcaagaccuacuacgccgacagcgugaagggcagauucaccaucagcagagacaacagcaagaacacccuguaccugcagaugaacagccugagagccgaggacaccgccguguacuacugcgccaaggaccugggcgaguacaagagcgacgagugggccaccgacuacuacgaccugagcaucgccuaccccgugcaggaccccagaggcguggccggcgccuucgacaucuggggccagggcaccauggugaccgugagcagc

SEQ ID NO: 32668 - RNA, 432 nt, Artificial Sequence
  derived and/or modified sequence opt4 from anti-HIV_cap256-048-150027_VR-Chain
gaggugcagcugguggagagcggcggcggccuggugcagcccggcggcagccugagacugagcugcgccgugagcggcuucaccuucagcagcuacaucaugcacugggugagacaggcccccggcaagggccuggaguggguggccgugaucagcuacgacggcagcaacaaggacuacgccgacagcgugaagggcagauucaccaucagcagagacaacagcaagaacacccuguaccugcagaugaacagccugagagccgaggacaccgcccuguacuacugcgccaaggaccugagagaguacgagugcgaggagugggccagcgacuacuacgacuucggcagagacuaccccugccaggaccccagaggcguggugggcaccuucgacaucuggggccagggcaccauggugaccgugagcagc

SEQ ID NO: 32669 - RNA, 432 nt, Artificial Sequence
  derived and/or modified sequence opt4 from anti-HIV_cap256-048-148246_VR-Chain
caggugcagcugguggagagcggcggcggcguggugcagcccggcagaagccugagacugagcugcgccaccagcggcuucaccuucagcaccuacagcaugcacugggugagacaggcccccggcaagggccuggaguggguggccgugaucagcuacgacggcagcaacgaguacuacguggacagcgugaagggcagauucaccaucagcagagacaacagcaagaacacccuguaccugcagaugaacagccugagaguggaggacaccgcccuguacuacugcgccaaggaccugggcggcaacaaggacgacgaguggggcaccgacuacuacgacuucagcguggccuaccccgugcaggaccccagagccgugagcggcaucuucgacguguggggccacggcaccauggugaccgugagcagc

SEQ ID NO: 32670 - RNA, 432 nt, Artificial Sequence
  derived and/or modified sequence opt4 from anti-HIV_cap256-048-147428_VR-Chain
caggugcagcugguggagagcggcggcggcguggugcagcccggcagaagccugagacugagcugcagcgccagcggcuucaccuucagcaacuacggcaugcacugggugagacaggcccccggcaagggccuggaguggguggccgugaucagcuucgacggcagcaacaagguguacgccgacagcgugaagggcagauucaccaucagcagagacaacagcaagaacacccuguaccuggagaugaacagccugagagccgaggacaccgccgaguacuacugcgccaaggaccugggcgagagcgacaaggaggaguggcccagcgacuacuacgacuucggcagagacuucaccggccaggugcccagagccguggugggcaucuucgacauguggggccagggcaccauggugaccgugagcagc

SEQ ID NO: 32671 - RNA, 432 nt, Artificial Sequence
  derived and/or modified sequence opt4 from anti-HIV_cap256-048-146603_VR-Chain
gaggugcagcugguggagagcggcggcggccuggugcagcccggcagaagccugagacugagcugcgccgccagcggcuucaccuucgacgacuacgccauccacugggugagacaggcccccggcaagggccuggaguggguggcccugaucagcuacgacggcaccgacaaguacuacgccgacagcgugaagggcagauucaccaucagcagagacaacagcaagaacacccuguaccugcagaugaacagccugagaguggaggacaccgccguguaccacugcgccaaggaccugggcggcaccaagagcgacgagugggccaccgacuacuacgaccugagcaucgccuaccccauccaggaccccggcgccguggugggcguguucgacaucuggggccagggcaccauggugaccgugagcagc

SEQ ID NO: 32672 - RNA, 432 nt, Artificial Sequence
  derived and/or modified sequence opt4 from anti-HIV_cap256-048-145735_VR-Chain
caggugcagcuggugcagagcggcggcggcguggugcagcccggcagaagccugagacugagcugcggcgccagcggcuucaccuucagcaacuacgccaugcacugggugagacaggcccccggcaagggccuggacuggguggccgugaucagcuacgacggcaccaacgagaaccacgccgacagcgugaagggcagauucaccaucagcagagacaacagcaagaacaccguguaccugcagaugaacagccugagagccgaggacaccgccguguacuacugcgccaaggacgugggcggcagcaaggacgacgagugggccaccgacuacuacgaccugagcaucgccuaccccgugcccgaccccagagccguggugggcgccuucgacaucuggggccagggcaccauggugaccgugagcagc

SEQ ID NO: 32673 - RNA, 432 nt, Artificial Sequence
  derived and/or modified sequence opt4 from anti-HIV_cap256-048-145116_VR-Chain
caggugcaccugguggagagcggcggcggcguggugcagcccggcggcagccugagacugagcugcgccgccagcggcuucaccuucagcaacuacggcaugcacugggugagacaggcccccggcaagggccuggaguggguggccgccaucagcuucgccggcaccaacaaguacuacgccgacagcgugaagggcagauucaccaucagcagagacaacagcaagaacgcccuguaccugcagaugaacagccugagagccgaggacaccgcccuguacuacugcgccaaggaccugagagagagcgagugcgaggagugggccagcgacuacuacgacuucggcagagacuaccccugccaggaccccagaggcguggugggcacccuggacaucuggggccagggcaccauggugaccgugagcagc

SEQ ID NO: 32674 - RNA, 432 nt, Artificial Sequence
  derived and/or modified sequence opt4 from anti-HIV_cap256-048-144077_VR-Chain
caggugaagcugguggagagcggcggcggcguggugcagcccggcagaagccugagacugagcugcgccgccagcggcuucacccugagcagcuacgccaugcacugggugagacaggcccccggcaagggccuggaguggguggccgugaucagcuacgacggcagcaacagauacaccgccgacagcgugaagggcagauucaccaucagcagagacaacagcaagaacacccugaaccugcagaugaacagccugagacccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccaccgugaccgugagcagc

SEQ ID NO: 32675 - RNA, 432 nt, Artificial Sequence
  derived and/or modified sequence opt4 from anti-HIV_cap256-048-142876_VR-Chain
caggugcagcugguggagagcggcggcggcguggugcagcccggcggcagccugagacugagcugcguggccagcggcuucaccuucagcaccuacggcaugcacugggugagacaggcccccggcaagggccuggaguggguggccuucaugagauucgacggcagcaacagauacuacggcgacagcgugaagggcagauucaccaucagcagagacaacagcaagaacacccuguaccugcagaugaucagccugagagccgaggacaccgccguguaccacugcgccaaggaccugggcggcaacaagcccgacgagugggccaccgacuacuacgaccugagcaucgccuaccccgugcaggaccccagagccguggugggcguguucgacaucuggggccagggcaccaucaucaccgugagcagc

SEQ ID NO: 32676 - RNA, 432 nt, Artificial Sequence
  derived and/or modified sequence opt4 from anti-HIV_cap256-048-140582_VR-Chain
caggugcagcugguggagagcggcggcggcguggugcagcccggcagaagccugagacugagcugcgccgccagcggcuucagcuucagcaacuacgccauggacugggugagacaggcccccggcaagggccuggaguggguggccuucgugagcagcgacggcagcaacaagaacuacgccgacagcgugaagggcagauucaccaucagcagagacaacagcaagaacaccguguaccugcagaugaacagccugagaguggaggacaccgccguguacuacugcgccaaggaccugggcgccaacaaggacgacgagugggccaccgacuacuacgaccugagcguggccuaccccgugcccgaccccagagccguggugggcgccuucgacguguggggccagggcaccauggugaccgugagcagc

SEQ ID NO: 32677 - RNA, 432 nt, Artificial Sequence
  derived and/or modified sequence opt4 from anti-HIV_cap256-048-139355_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccaucaucagcuacgacggcagcaacaaguacuacgccgacagcgugaagggcagauucaccaucagcagagacaacagcaagggcacccuguaccugcagauggacggccccagacccgaggacaccgcccuguacuacugcgccaaggaccugggcgagagagagugcgaggagugggccagcgacuacuacgacuucggcagagacuuccccugccaggaccccagaggcguggugggcaccuucgacaucuggggccagggcaccauggugaccgugagcagc

SEQ ID NO: 32678 - RNA, 432 nt, Artificial Sequence
  derived and/or modified sequence opt4 from anti-HIV_cap256-048-139151_VR-Chain
caggugcagcugguggagagcggcggcggcguggugcagcccggcaagagccugagacugagcugcgccgccagcggcuucaccuucaacaccuacggcaugcacugggugagacaggcccccggcaagggccuggaguggguggccgugaucagcuacgacggcagcauccagaaguacgccgacagcgugaagggcagauucaccaucagcagagacaacagcaagaacacccuguaccugcagaugaacagccugagcguggaggacaccgccguguacuacugcgccaaggaccugggcaagaacaaggacgacgagugggccaccgacuacuacgacaucagcaucgccuaccccgugcccgaccccagagccguggugggcguguucgacaucuggggccagggcaccguggugaccgugagcagc

SEQ ID NO: 32679 - RNA, 432 nt, Artificial Sequence
  derived and/or modified sequence opt4 from anti-HIV_cap256-048-137672_VR-Chain
gaggugcagcugguggagagcggcggcggcguggccagacccggcggcagccugagacugagcugcgccgccagcggcuucaucuucacccacuacgccauggacugggugagacaggcccccggcaagggccuggaguggguggccgugaucagcagcgacggcagcagcaagaacuacgccgacagcgugaagggcagauucaccaucagcagagacaacagcaagaacaccgugagccugcagaugaacagccugagacccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32680 - RNA, 432 nt, Artificial Sequence
  derived and/or modified sequence opt4 from anti-HIV_cap256-048-137506_VR-Chain
caggugagacugguggacagcggcggcggcguggugcagcccggcggcagccugagacugagcugcgccgccagcggcuucaccuucagcaccuacggcaugcacugggugagacaggcccccggcaagggccuggaguggguggccuucaucagaagcgacggcagcaacaaguacuacgccgacagcgugcagggcagauucagcaucagcagagacaacagcaagaacacccuguaccugcagaugaacagccugagagccgaggacaccgccguguacuacugcgccaaggaccugggcgagagcgacaaggaggaguggcccagcgacuacuacgacuucggcagagacuucaccggccaggaccccagagccguggugggcguguucgacaucuggggccagggcaccaccgugaucgugagcagc

SEQ ID NO: 32681 - RNA, 432 nt, Artificial Sequence
  derived and/or modified sequence opt4 from anti-HIV_cap256-048-137270_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgugaugagccccgacggcagcaacagauacuacaccgacagcgugaagggcagauucaccaucagcagagacaacagcaagaacacccugagccugcagaugaacagccugagacccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32682 - RNA, 432 nt, Artificial Sequence
  derived and/or modified sequence opt4 from anti-HIV_cap256-048-135447_VR-Chain
gaggugcagcugguggagagcggcggcgccguggugcagcccggcagaagccugagacugagcugcaccgccagcggcuucagcuucaccagcuacaccauccacugggugagacaggcccccggcaagggccuggaguggguggccuucaucagcuacgacggcaccgagaagaaguacaccgacagcgugaagggcagauucaccaucagcagagacaacagcaagaacacccugagccugcagaugaacagccugagacccgaggacaccgccguguacuacugcgccaaggaccugggcgccagcaaggacgacgagugggccaccgacuacuacgacuucagcaucgccuaccccgugcaggaccccagagccguggugggcgccuucgacaucuggggccagggcaccauggugaccgugagcagc

SEQ ID NO: 32683 - RNA, 432 nt, Artificial Sequence
  derived and/or modified sequence opt4 from anti-HIV_cap256-048-131966_VR-Chain
caggagcagcugguggagagcggcggcggcguggugcagcccggcagaagccugagacugagcugcgccgccagcggcuucaccuucagcaacuacgccaugcacugggugagacaggcccccggcaagggccuggaguggguggccgccaugagccacgacggcagcgacaaguacuacgccgacagcgugaagggcagauucaccaucagcagagacaacagcaagaacacccuguacaugcagaugaacagccugagagccgaggacaccgccguguacuacugcgccaaggaccagggcgagagcgagaaggaggagugggccagcgacuacuacgacuucggcagagacuaccccggccaggaccccagaagagugguggccaccuucgccaucuggggccagggcaccauggugaccgugagcagc

SEQ ID NO: 32684 - RNA, 432 nt, Artificial Sequence
  derived and/or modified sequence opt4 from anti-HIV_cap256-048-131008_VR-Chain
gaggugagacugguggagagcggcggcggccuggugaagcccggcggcagccugagacugagcugcgccgccagcggcuucaccgugagcagcaacuacaugagcugggugagacaggcccccggcaagggccuggaguggguggccgccaucagcuucgccggcaccaacaaguacuacgccgacagcgugaagggcagauucaccaucagcagagacaacagcaagaacgcccuguaccugcagaugaacagccugagagccgaggacaccgcccuguacuacugcgccaaggaccugagagagagcgagugcgaggagugggccagcgacuacuacgacuucggcagagacuaccccugccaggaccccagaggcguggugggcacccuggacaucuggggccagggcaccauggugaccgugagcagc

SEQ ID NO: 32685 - RNA, 432 nt, Artificial Sequence
  derived and/or modified sequence opt4 from anti-HIV_cap256-048-129369_VR-Chain
caggugcagcugguggagagcggcggcggcguggugcagcccggcagaagccugagacugagcugcgccgccagcggcuucaccuucagcaacuacgugaugcacugggugagacaggcccccggcaagggccuggaguggguggcccuggugagcuucgacggcagcaacaaguacuacgccgacagcgugaagggcagauucaccaucagcagagacaacagcaagaacaccguguaccugcagaugaacagccugagaggcguggacaccgccguguacuacugcgccaaggaccugggcggcggcgagguggaggagugggccaccgacuacuacgacuggagcaucgccuaccccguggagcaccccagagccguggugggcguguucgacaucuggggccagggcaccaaggugaccgugagcagc

SEQ ID NO: 32686 - RNA, 432 nt, Artificial Sequence
  derived and/or modified sequence opt4 from anti-HIV_cap256-048-128476_VR-Chain
gaggugcaggugcuggagagcggcggcggccuggugcagcccggcggcagccugagacuggccugcgccgccagcggcuucagcuucagcagcuacggcaugcacugggugagacaggcccccggcaagggccuggagugggugagcuucaucagauacgacggcgccaacaaguaccacgccgacagcgugaagggcagauucaucaucagcagagacgacagcaagaacaccgugagccugcagaugaacagccugagacccgaggacaccgccguguacuacugcgccaaggaccugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32687 - RNA, 432 nt, Artificial Sequence
  derived and/or modified sequence opt4 from anti-HIV_cap256-048-128270_VR-Chain
caggugcagcugguggagagcggcggcggcguggugcagcccggcagaagccugagacugagcugcaccgccagcggcuucaccuucagaagcuacgccaugcacugggugagacaggcccccggcaagggccuggaguggguggcccugaucagcuacgacggcagcaacaaguacuacgccgacagcgugaagggcagauucaccaucagcagagacaacagcaagaacacccuguaccugcagaugaacagccugaccagcgaggacaccgccguguacuacugcgccaaggaccugggcggcagcaagaccgacgaguggggcaccgacuacuacgaguucuggaacgccuaccccgugcaggaccccagagugguggugggcgccuucgacaucuggggccacggcaccauggugaccgugagcagc

SEQ ID NO: 32688 - RNA, 432 nt, Artificial Sequence
  derived and/or modified sequence opt4 from anti-HIV_cap256-048-126220_VR-Chain
caggugcagcugguggagagcggcggcggcguggugcagcccggcagaagccugagacugagcugcgccgccagcggcuucaucuucagccccuacggcauccacugggugagacaggcccccggcaagggccuggaguggguggcccugaucagccacgacggcagcaagaaguacuacgccgacagcgugaagggcagauucaccaucagcagagacaacuucaaggacacccuguaccugcagaugaacagccugagaggcguggacaccgccguguacuacugcgccaaggaccugggcggcggcgagguggaggagugggccaccgacuacuacgacuggagcaccgccuaccccguggagcaccccagagccguggugggcguguucgacaucuggggccagggcaccaaggugaccgugagcagc

SEQ ID NO: 32689 - RNA, 432 nt, Artificial Sequence
  derived and/or modified sequence opt4 from anti-HIV_cap256-048-125713_VR-Chain
gaggugcagcugguggagagcggcggcggccuggugcagcccggcggcagccugagacugagcugcgaggccagcggcuucagcuucagcaccuacgagcugaacugggugagacaggcccccggcaagggccuggaguggguggccgugaucagcuacgacggcagcaacuacuacuacgccgacagcgugaagggcagauucaccaucagcagagacaacagcaagaacacccuguaccugcagaugaacagccugagagccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32690 - RNA, 432 nt, Artificial Sequence
  derived and/or modified sequence opt4 from anti-HIV_cap256-048-123934_VR-Chain
caggugcagcugguggagagcggcggcggcguggugcagcccggcagaagccugagacugagcugcgccgccagcggcuucaccuucagcagcuacggcauggccugggugagacaggcccccggcaagggccuggagugggugaccgccaucagcuucgccggcaccaacaaguacuacgccgacagcgugaagggcagauucaccaucagcagagacaacagcaaggacacccuguaccugcagauggacggccugagacccgaggacaccgcccuguacuacugcgccaaggaccugggcgagagagagugcgaggagugggccagcgacuacuacgacuucggcagagacuuccccggccaggaccagagagccguggccggcguguucgacauguggggccagggcaccauggugaccgugagcagc

SEQ ID NO: 32691 - RNA, 432 nt, Artificial Sequence
  derived and/or modified sequence opt4 from anti-HIV_cap256-048-122673_VR-Chain
gaggugcaggugguggagagcggcggcggccuggugaagcccggcggcagccugagacugagcugcgccgccagcggcuucaccuucagcagccacgugaugaacugggugagacaggcccccggcaagggccuggagugggugagcagcaucagcggcggcagcagcagcaaggacuacgccgacagcgugaagggcagauucaccaucagcagagacaacagcaagaacacccugagccugcagaugaacagccugagacccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32692 - RNA, 432 nt, Artificial Sequence
  derived and/or modified sequence opt4 from anti-HIV_cap256-048-122208_VR-Chain
agagugcaggugguggagagcggcggcggcguggugaagcccggcggcagccugagacugagcugcggcgccagcggcuucaccuucagcaacgccuggcugagcugggugagacaggcccccggcaagggccuggaguggguggccgugaucagcagcgacggcagcagcaagaacuacgccgacagcgugaagggcagauucaccaucagcagagacaacagcaagaacaccgugagccugcagaugaacagccugagacccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32693 - RNA, 432 nt, Artificial Sequence
  derived and/or modified sequence opt4 from anti-HIV_cap256-048-121552_VR-Chain
caggugcagcugguggagagcggcggcggcguggugcagcccggcggcagccugagacugagcugcgccgccagcggcuucaccuucagcagcuacgccaugcacugggugagacaggcccccggcaagggccugaaguggguggccgacaucagcuacgacgccagcagcaaguacuacgccgacagcgugaagggcagauucaccaucagcagagacaacagcaagaacacccuguaccuggagaugaacagccugagacccgaggacaccgccguguacuacugcgccaaggaccugggcgagagagagugcgaggagugggccagcgacuacuacgacuucggcagagacuuccccugccaggaccccagaggcguggugggcaccuucgacaucuggggccagggcaccauggugaccgugagcagc

SEQ ID NO: 32694 - RNA, 432 nt, Artificial Sequence
  derived and/or modified sequence opt4 from anti-HIV_cap256-048-120643_VR-Chain
caggugcagcugguggagagcggcggcggcguggugcagcccggcagaagccugagacugagcugcgccgccagcggcuucacccugagcgccuacaccaugcacugggugagacaggcccccggcaagggccuggagugggugagcgugaucagcuucgccggcaacaacaaguacuacgccgacagcgugaagggcagauucaccaucagcagagagaacagcaagaacaugcuguaccugcagaugaacagccugagaggcgaggacaccgccguguacuacugcgccaaggaccugagagaguucgagugcgaggagugggccagcgacuacuacgacuucggcagagacuaccccugccaggaccccagaggcguggugggcaccuucgacguguggggccacggcagccuggugaccgugagcagc

SEQ ID NO: 32695 - RNA, 432 nt, Artificial Sequence
  derived and/or modified sequence opt4 from anti-HIV_cap256-048-118458_VR-Chain
caggugcagcugguggagagcggcggcggcguggugcagcccggcagaagccugagacugagcugcgccgccagcggcuucaccuucagcaccagcggcaugcacugggugagacaggcccccggcaagggccuggaguggguggccuucaucagcagcgacagaagcaacaaguucuacgccgacagcgugaagggcagauucagcaucagcagagacaacagcaaguacacccuguaccugcagaugaacagccugagagccgacgacaccgccguguacuucugcgccaaggaccugggcgugaacaagaacgacgagugggccaccgacuacuacgaccugagcguggccuaccccgugcaggaccccagaggcguggccggcaucuucgacaucuggggccagggcaccauggugaccgugagcagc

SEQ ID NO: 32696 - RNA, 432 nt, Artificial Sequence
  derived and/or modified sequence opt4 from anti-HIV_cap256-048-118112_VR-Chain
caggagcagcugguggagagcggcggcggcguggugcagcccggcagaagccugagacugagcugcgccgccagccaguucaccuucagcaacuacggcaugcacugggugagacaggcccccggcaagggccugguguggguggccggcaucagcuucgccggcaccaacaaguacuacgccgccagcgugaagggcagauucaccaucagcagagacaacagcaagaacacccuguaccugcagaugaacagccugagagccgaggacaccgcccuguacuacugcgccaaggacaugagagaguacgagugcgaggagugggccagcgacuacuacgacuucggcagagacuaccccugccaggaccccagaggcguggugggcaccuucgacaucuggggccagggcaccauggugaccgugagcagc

SEQ ID NO: 32697 - RNA, 432 nt, Artificial Sequence
  derived and/or modified sequence opt4 from anti-HIV_cap256-048-116469_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccaucaucagcuacgacggcagcaacaaguacuacgccgacagcgugaagggcagauucaccaucagcagagacaaccccaagaacacccuguaccugcagaugaacagccugagagccgaggacaccggccuguacuacugcgccaaggacaugggcgagagcgagaaggaggagugggccagcgacuacuacgacuucggcagagacuaccccggccaggagcccagagccauggugggcaccuucgacaucuggggccagggcaccauggugaccgugagcagc

SEQ ID NO: 32698 - RNA, 432 nt, Artificial Sequence
  derived and/or modified sequence opt4 from anti-HIV_cap256-048-113917_VR-Chain
gaggugcagcugguggagagcggcggcggccuggugcagcccggcggcagccugagacugagcugcgccgccagcggccugaccgugagcgacaccuacaugaacuggcugagacaggcccccggcaagggccuggaguggguggccguggugagcagcgacggcagcaacaagaacuacgccgacagcgugaagggcagauucaccaucagcagagacaacagcaagaacaccguguaccugcagaugaacagccugagagccgaggacaccgccguguacuacugcgccaaggaccugggcgccaacaaggacgacgagugggccaccgacuacuacgaccugagcguggccuaccccgugcccgaccccagagccguggugggcgccuucgacguguggggccagggcaccauggugaccgugagcagc

SEQ ID NO: 32699 - RNA, 432 nt, Artificial Sequence
  derived and/or modified sequence opt4 from anti-HIV_cap256-048-112368_VR-Chain
caggugcagcugguggagagcggcggcggcguggugcagcccggcagaagccugagacugagcugcgccgccagcggcuucaccuucagcagaaacgccaugcacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcggcggcgagguggaggagugggccaccgacuacuacgacuggagcaccgccuaccccguggagcaccccagagccguggugggcguguucgacaucuggggccagggcaccaaggugaccgugagcagc

SEQ ID NO: 32700 - RNA, 432 nt, Artificial Sequence
  derived and/or modified sequence opt4 from anti-HIV_cap256-048-112047_VR-Chain
gaggugcagcugguggagagcggcggcggccuggugcagcccggcggcagccugagacugagcugcgccgccagcggccugaccgugagcggcuacuacaugagcugggugagacaggcccccggcaagggccuggaguggcuggccuucauccacuucgacggcagcaagauccacuacgccggcagcgugaagggcagaaucaccgugagcagagacaacagcaagaacacccuggaccugcagaugaacagccugagagccgaggacaccgccguguacuacugcgccaaggacgugggcgacagcaagagcgacgagugggccaccgacuacuacgaccugagcguggccuaccccgugcccgaccccagagccguggugggcgccuucgacaucuggggccagggcaccauggugaccgugagcagc

SEQ ID NO: 32701 - RNA, 432 nt, Artificial Sequence
  derived and/or modified sequence opt4 from anti-HIV_cap256-048-112029_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccggcaucagcuucgccggcaucaagaaguacuacgccgacagcgugaagggcagauucaccaucagcagagacaacagcaagaacacccuguaccugcagaugaacagccugagaggcgaggacaccgcccuguacuacugcgccaaggaccugagagaguacgagugcgaggagugggccagcgacuacuacgacuucggcagagacuaccccugccaggaccccagaggcguggugggcaucuucgacaucuggggccagggcaccauggugaccgugagcagc

SEQ ID NO: 32702 - RNA, 432 nt, Artificial Sequence
  derived and/or modified sequence opt4 from anti-HIV_cap256-048-110957_VR-Chain
caggugagacugguggagagcggcggcggcguggugagaagcggcagaagccugagacugagcugcgccgccagcggcuucaccuucagcaacuucgcccugcacugggugagacaggcccccggcaagggccuggaguggguggccgugaucagcuacgacggcaacagcaaguucuacgccgacagcgugaagggcagauucaccaucagcaccgacaacagcaagaacacccuguaccugcagaugaacagccugaccgccgaggacaccgccguguacuacugcgccaaggaccugggcggcaacaaggacgacgaguggggcaccgacuacuacgacuucagcguggccuaccccgugcaggaccccagagccgugagcggcaucuucgacguguggggccacggcaccauggugaccgugagcagc

SEQ ID NO: 32703 - RNA, 432 nt, Artificial Sequence
  derived and/or modified sequence opt4 from anti-HIV_cap256-048-110526_VR-Chain
caggugcagcugguggagagcggcggcggcguggugcagcccggcagaagccugagacugagcugcgccgccagcggcuucaccuucagcaacuucggcuuccacugggugagacaggcccccggcaagggccuggaguggguggccgccaucagcuucgccggcaacaacaaguacuacgccgacagcgugaagggcagauucaccaucagcagagagaacagcaagaacauccuguaccugcagaugaacagccugagaggcgaggacaccgccguguacuacugcgccaaggaccugagagaguucgagugcgaggagugggccagcgacuacuacgacuggagcaccgccuaccccguggagcaccccagagccguggugggcguguucgacaucuggggccagggcaccaaggugaccgugagcagc

SEQ ID NO: 32704 - RNA, 432 nt, Artificial Sequence
  derived and/or modified sequence opt4 from anti-HIV_cap256-048-109336_VR-Chain
gaggugcagcugguggagagcggcggcggccuggugcagcccggcggcagccagagacugagcugcgccgccagcggccugaccgugaacagcaacuacaugaccugggugagacaggcccccggcaagggccuggaguggguggccaucaucagcagcgacggcagcggccaguacuacgccgacagcgugaagggcagauucaccaucagcagagacaacagcaagaacacccugagccugcagaugaacagccugagacccgaggacaccgccguguacuacugcgccaaggaccugggcgccagcaaggacgacgagugggccaccgacuacuacgacuucagcaucgccuaccccgugcaggaccccagagccguggugggcgccuucgacaucuggggccagggcaccauggugaccgugagcagc

SEQ ID NO: 32705 - RNA, 432 nt, Artificial Sequence
  derived and/or modified sequence opt4 from anti-HIV_cap256-048-108152_VR-Chain
caggcccagcugguggagagcggcggcggcguggugcagcccggcagaagccuggugcugagcagcguggccagcggcuucagcuucagcaccuacgccaugcacugggugagacaggcccccggcaagggccuggaguggguggccgugaucagcuacgacggcggcaacaaguacuacgccgacagcgugaagggcagauucagcaucagcagagacaacagcaagaacaccguguaccugcagaucaacagccugagagccgaggacaccgccguguacuacugcgccaaggaccugggcgccaacaaggacgacgagugggccaccgacuacuacgaccugagcguggccuaccccgugcccgaccccagagccguggugggcgccuucgacguguggggccagggcaccauggugaccgugagcagc

SEQ ID NO: 32706 - RNA, 432 nt, Artificial Sequence
  derived and/or modified sequence opt4 from anti-HIV_cap256-048-107799_VR-Chain
gaggugcaggugguggagagcggcggcggcguggugcagcccggcagaagccugagacugagcugcgccgccagcggcuucaccuucagcaacuacgccauggacugggugagacaggcccccggcaagggccuggaguggguggccuucgugagcagcgacggcagcaacaagaacuacgccgacagcgugaagggcagauucaccaucagcagagacaacagcaagaacacccugagccugcagaugaacagccugagagccgaggacaccgccguguacuacugcgccaaggaggugggcgagaacaaggacgacgagugggccagcgacuacuacgaccugagcaucgccuaccccauccacgaccccagagccguggugggcggcuucgacaucuggggccagggcaccauggugaccgugagcagc

SEQ ID NO: 32707 - RNA, 432 nt, Artificial Sequence
  derived and/or modified sequence opt4 from anti-HIV_cap256-048-107384_VR-Chain
gaggugagacugguggagagcggcggcgcccuggugaagcccggcaccagccugagacugagcugcgccgccagcggcuucaccuucacccacuacgccauggacugggugagacaggcccccggcaagggccuggaguggguggccaucaucagcagcgacggcagcaccaagaacuacgccgacagcgugaagggcagauucaccaucagcagagacaacagcaagaacacccugagccugcagaugaacagccugagacccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32708 - RNA, 432 nt, Artificial Sequence
  derived and/or modified sequence opt4 from anti-HIV_cap256-048-106530_VR-Chain
gaggugcagcugcuggagagcggcggcggccuggugcagcccggcggcagccugagacugagcugcgccgccagcggcuucaccuucagcagcuacgccauggacugggugagacaggcccccggcaagggccuggaguggguggccgugaucagcagcgacggcagcaacaagaacuacgccgacagcgugaagggcagauucaccaucagcagagacaacagcaagaacacccuguaccugcagaugagcagccugagacccgaggacaccgccguguacuacugcgccaaggacgugggcgacagcaagagcgacgagugggccaccgacuacuacgacuucagcaucgccuaccccauccaggaccccagagccguggugggcgccuucgacaucuggggccagggcaccauggugaccgugagcagc

SEQ ID NO: 32709 - RNA, 432 nt, Artificial Sequence
  derived and/or modified sequence opt4 from anti-HIV_cap256-048-106464_VR-Chain
gaggugcagauggugcagagcggcggcggccuggugcagcccggcggcagccugagacugagcugcgccgccuucggcuucaccuucaccaaccacgccauggacugggugagacaggugcccggcaagggccuggaguggguggccuucaucagcagcgacggcagcaacaagaacuacgccgacagcgugaagggcagauucaccaucagcagagacaacagcaagaacaccguguaccugcagaugagcagccugagacccgaggacaccgccguguacuacugcgccaaggacgugggcgacagcaagagcgacgagugggccaccgacuacuacgaccugagcguggccuaccccgugcccgaccccagagccguggugggcgccuucgacaucuggggccagggcaccauggugaccgugagcagc

SEQ ID NO: 32710 - RNA, 432 nt, Artificial Sequence
  derived and/or modified sequence opt4 from anti-HIV_cap256-048-106411_VR-Chain
caggugcagcugguggagagcggcggcggcguggugcagcccggcagaagccugagacugagcugcgccgccagcggcuucaccuucagcuacagcggcaugcacugggugagacaggcccccggcaagggcauggaguggguggccgugaucagcuacgacggcagcaacaaguacuacgccgacagcgugaagggcagauucaccaucagcagagacaacagcaagaacacccuguaccugcagaugaacagccugagaguggaggacaccgccguguaccacugcgccaaggaccugggcggcaccaagagcgacgagugggccaccgacuacuacgaccugagcaucgccuaccccauccaggaccccggcgccguggugggcguguucgacaucuggggccagggcaccauggugaccgugagcagc

SEQ ID NO: 32711 - RNA, 432 nt, Artificial Sequence
  derived and/or modified sequence opt4 from anti-HIV_cap256-048-106306_VR-Chain
gaggugcagcugguggagagcggcggcggccuggugcagcccggcggcagccugagacugagcugcgaggccagcggcuucaccuucaacaacuacggcauggugugggugagacaggcccccggcaagggccuggaguggguggccaucaucagcuacgacggcaccgagaaguacuacguggacagcgugaagggcagauucaccaucagcagagacaacagcaagaacacccugagccugcagaugaacagccugagagccgaggacaccgccguguacuacugcgccaaggaggugggcgagaacaaggacgacgagugggccagcgacuacuacgaccugagcaucgccuaccccauccacgaccccagagccguggugggcggcuucgacaucuggggccagggcaccauggugaccgugagcagc

SEQ ID NO: 32712 - RNA, 432 nt, Artificial Sequence
  derived and/or modified sequence opt4 from anti-HIV_cap256-048-104496_VR-Chain
caggugcagcugguggagagcggcggcggccuggugaagcccggcggcagccugagacugagcugcgccgccagcggcuucaccuucagcagcuacggcaugcacugggugagacaggcccccggcaagggccuggaguggguggccuucgugagcagcgacggcaacaacaagaacuacgccgacagcgugaagggcagauucaccaucagcagagacaacagcaagaacaccguguaccugcagaugaacagccugagaguggaggacaccgccguguacuacugcgccaaggaccugggcgccaacaaggacgacgagugggccaccgacuacuacgaccugagcguggccuaccccgugcccgaccccagagccguggugggcgccuucgacguguggggccagggcaccauggugaccgugagcagc

SEQ ID NO: 32713 - RNA, 432 nt, Artificial Sequence
  derived and/or modified sequence opt4 from anti-HIV_cap256-048-103074_VR-Chain
caggugcaccugguggagagcggcgccggcguggugcagcccggcggcagccugagacugagcugcgccgugagcggcuucaccuucaacagcuacggcaugcacugggugagacaggcccccggcaagggccuggaguggguggccgugaucagcuacgacggcagcgacaaguacuacgccgacagcgugaagggcagauucaccaucagcagagacagcagcaagaacacccuguaccugcagaugaacagccugagaguggaggacaccgccguguacuacugcgccaaggaccugggcgccaacaaggacgacgagugggccaccgacuacuacgaccugagcguggccuaccccgugcccgaccccagagccguggugggcgccuucgacguguggggccagggcaccauggugaccgugagcagc

SEQ ID NO: 32714 - RNA, 432 nt, Artificial Sequence
  derived and/or modified sequence opt4 from anti-HIV_cap256-048-100832_VR-Chain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccguggugagcagcgacggcaccaacaagaacuacggcgacagcgugaagggcagauucaccaucagcagagacaacagcagaaacaccguguaccugcagaugagcagccugagacccgaggacaccgccguguacuacugcgccaaggacgugggcgacaccaagagcgacgagugggccaccgacuacuacgacuucagcaucgccuaccccgugcaggaccccagagccguggugggcgccuucgacaucuggggccagggcaccauggugaccgugagcagc

SEQ ID NO: 32715 - RNA, 432 nt, Artificial Sequence
  derived and/or modified sequence opt4 from anti-HIV_cap256-048-100188_VR-Chain
caggugcaccugguggagagcggcggcggcguggugcagcccggcagaagccugagaaucuacugcgccgugagcgaguucaccuucagaaacuacgccaugcacugggugagacuggcccccggcaagggccugcaguggguggccgugaucagcuacaacggcggcaagaaguacuacgccgacagcgugaagggcagauucaccaucagcagagacaacagcaagaacgcccuguaccugcagaugaacagccugagagccgaggacaccggccuguacuacugcgccaaggaccugagagaguucgagugcgaggagugggccagcgacuacuacgacuucggcagagaguaccccugccaggaccccagaggcguggugggcaccuucgacaucuggggccagggcaccauggugaccgugagcagc

SEQ ID NO: 32716 - RNA, 432 nt, Artificial Sequence
  derived and/or modified sequence opt4 from anti-HIV_cap256-048-099645_VR-Chain
caggugcagcugguggagagcggcggcggcguggugcagcccggcagaagccugagacugagcugcgccgccagcggcuucaccuucagcagauacgcccugcacugggugagacaggcccccggcaagggccuggaguggguggccgugaucagcuacgacggcagcagcaaguacuacgccgacagcgugaagggcagauucagcaucagcagagacaacagcaaguacacccuguaccugcagaugaacagccugagagccgacgacaccgccguguacuucugcgccaaggaccugggcgugaacaagaacgacgagugggccaccgacuacuacgaccugagcguggccuaccccgugcaggaccccagaggcguggccggcaucuucgacaucuggggccagggcaccauggugaccgugagcagc

SEQ ID NO: 32717 - RNA, 432 nt, Artificial Sequence
  derived and/or modified sequence opt4 from anti-HIV_cap256-048-098137_VR-Chain
caggugcagcugguggagagcggcggcggcguggugcagcccggcagaagccugagacugagcugcgccgccagcggcuucacccugagaaacuacgccaugcacugggugagacaggcccccggcaagggccuggaguggguggccgugaucagcagcgacggcaacaacaaguacuacgccgacagcgugaagggcagauucaccgugagcagagacaacagcaaggacacccuguaccugcagaugaacagccugagacccgaggacaccgcccuguacuacugcgccaaggaccugggcgagagagagugcgaggagugggccagcaacuacuacgacuucggcagagacuaccccugccaggaccccagaggcguggugggcaccuucgacaucuggggccagggcaccauggugaccgugagcagc

SEQ ID NO: 32718 - RNA, 432 nt, Artificial Sequence
  derived and/or modified sequence opt4 from anti-HIV_cap256-048-097878_VR-Chain
caggugcagcugcuggagagcggcggcggcguggugcagcccggcaagagccugagacugagcugcgccgccagcggcuucaccuucaacaccuacggcaugcacugggugagacaggcccccggcaagggccugcaguggguggccgugaucagcuacgacggcaccauccagaaguacgccgacagcgugaagggcagauucaccaucagcagagagaacagcaagaacaugcuguaccugcagaugaacagccugagaggcgaggacaccgccguguacuacugcgccaaggaccugagagaguucgagugcgaggagugggccagcgacuacuacgacuucggcagagacuaccccugccaggaccccagaggcguggugggcaccuucgacguguggggccacggcagccuggugaccgugagcagc

SEQ ID NO: 32719 - RNA, 432 nt, Artificial Sequence
  derived and/or modified sequence opt4 from anti-HIV_cap256-048-097510_VR-Chain
caggugcagcugguggagagcggcggcggcguggugcagcccggcagaagccuguggcugagcugcgccgccagcgaguucacccugagaagcuacggcaugcacugggugagacaggcccccggcaagggccuggaguggguggccuucguggccuucgacgagagcgacaaguacuacgccgacagcgugaagggcagauucaccaucagcagagacaacagcaagaacacccugagccugcagaugaacagccugagagccgaggacaccgccguguacuacugcgccaaggaggugggcgacaacaaggacgacgagugggccagcgacuacuacgaccugagcaucgccuaccccgugcacgaccccagagccguggugggcggcuucgacaucuggggccagggcaccauggugaccgugagcagc

SEQ ID NO: 32720 - RNA, 432 nt, Artificial Sequence
  derived and/or modified sequence opt4 from anti-HIV_cap256-048-097313_VR-Chain
caggugcagcugguggagagcggcggcggccuggugcagcccggcggcgcccugagacugagcugccuggugagcggcuucaccuucgacgacuacgcccugcacugggugagacaggcccccggcaagggccccgaguggguggccgugcugagcagcgacggcagcuacaaguacuacaccgagagcgugcagggcagauucaccaucagcagagacaacagcaagaacaccguguaccugcagaugaacagccugagaggcguggacaccgccguguacuacugcgccaaggaccugggcggcggcgagguggaggagugggccaccgacuacuacgacuggagcaucgccuaccccguggagcaccccagagccguggugggcguguucgacaucuggggccagggcaccaaggugaccgugagcagc

SEQ ID NO: 32721 - RNA, 432 nt, Artificial Sequence
  derived and/or modified sequence opt4 from anti-HIV_cap256-048-096626_VR-Chain
gaggugcagcugguggagagcggcggcggccuggugcagcccggcgagagccugagacugagcugcgccggcagcggcuucaccuucagcagcuacuggaugagcugggugagacaggcccccggcaagggccuggaguggauggcccugaucagcuacgacggcagcaacaaguacuacguggacagcgugaagggcagauucaccaucagcagagacaacagcaagaacacccuguaccugcagaugaacagccugagagccgaggacaccgccguguacuacugcgccaaggaccugggcggcaacaaggacgacgagugggccaccgacuacuacgaccugagcaucgccuaccccgugcaggaccccagagugguggugggcaucuucgacaucuggggccagggcaccauggugaccgugagcagc

SEQ ID NO: 32722 - RNA, 432 nt, Artificial Sequence
  derived and/or modified sequence opt4 from anti-HIV_cap256-048-096483_VR-Chain
gaggugcagcugguggagagcggcggcggccuggugcagcccggcagaagccugagacugagcugcgccgccagcggcuucagcuucgaggacuacgccaugcacugggugagacaggcccccggcaagggccuggaguggguggccggcaucagcuucgccggcaccaagaaguacuacgccgacagcgugaagggcagauucaccaucagcagagacaacagcaagaacgcccuguaccugcagaugaacagccugagagccgaggacaccgcccuguacuacugcgccaaggaccugagagaguacgagugcgaggagugggccagcgacuacuacgacuucggcagagacuaccccugccaggaccccagaggcguggugggcaccuucgacaucuggggccagggcaccauggugaccgugagcagc

SEQ ID NO: 32723 - RNA, 432 nt, Artificial Sequence
  derived and/or modified sequence opt4 from anti-HIV_cap256-048-095691_VR-Chain
caggugcagcugguggagagcggcggcggcguggugcagcccggcagaagccugagacugagcugcgccgccagcggcuucaccuucagcagcuacggcauggccugggugagacaggcccccggcaagggccuggagugggugaccgccaucagcuucgccggcaccaacaaguacuacgccgacagcgugaagggcagauucaccaucagcagagacaacagcaaggacacccuguaccugcagauggacggccugagacccgaggacaccgcccuguacuacugcgccaaggaccugggcgagagagagugcgaggagugggccagcaacuacuacgacuucggcagagacuaccccugccaggaccccagaggcguggugggcaccuucgacaucuggggccagggcaccauggugaccgugagcagc

SEQ ID NO: 32724 - RNA, 432 nt, Artificial Sequence
  derived and/or modified sequence opt4 from anti-HIV_cap256-048-095525_VR-Chain
caggugcagcuggugcagagcggcggcagcguggugcagcccggcaagagccugagacugagcugcgccgccagcggcuucaccuucagcagcuucggcaugcacugggugagacagacccccggcaagggccuggaguggguggccgugaucagcuacgacggcagcgagaagagcuacgccgacagcgugaagggcagauucaccaucagcagagacaacagcaagaacacccuguaccugcagaugaacagccugagagccgaggacaccgccguguacuacugcgccaaggaccugggcggcaccaaggacgacgagugggccaccgacuacuacgacaucagcaucgccuaccccgugcaggaccccagagccguggccggcgccuucgacaucuggggccagggcaccauggugaccgugagcagc

SEQ ID NO: 32725 - RNA, 432 nt, Artificial Sequence
  derived and/or modified sequence opt4 from anti-HIV_cap256-048-094783_VR-Chain
gaggugcagcugguggagagcggcggcggccuggugaagcccggcggcagccugagacugagcugcgccgccagcggcaucaccuucagcaccuacgagaugaacugggugagacaggcccccggcaagggcauggaguggguggccgugaucagcuacgacggcagcaacaaguacuacgccgacagcgugaagggcagauucaccaucagcagagacaacagcaagaacaccguguaccugcagaugaacagccugagaggcguggacaccgccguguacuacugcgccaaggaccugggcggcggcgagguggaggagugggccaccgacuacuacgacuggagcaucgccuaccccguggagcaccccagagccguggugggcguguucgacaucuggggccagggcaccaaggugaccgugagcagc

SEQ ID NO: 32726 - RNA, 432 nt, Artificial Sequence
  derived and/or modified sequence opt4 from anti-HIV_cap256-048-094356_VR-Chain
caggugcagcugguggagagcggcggcggcguggugcagcccggcagaagccugagacugagcugcgccgccagcggcuucaucuucacccacuacgccauggacugggugagacaggcccccggcaagggccuggaguggguggccgugaucagcagcgacggcagcagcaagaacuacgccgacagcgugaagggcagauucaccaucagcagagacaacagcaagaacaccgugagccugcagaugaacagccugagacccgaggacaccgccguguacuacugcgccaaggacgugggcgacaacaagagcgacgagugggccaccgacuacuacgacuucagcaucgccuaccccgugcccgaccccagagccguggugggcgccuucgaccuguggggccagggcaccauggugaccgugagcagc

SEQ ID NO: 32727 - RNA, 432 nt, Artificial Sequence
  derived and/or modified sequence opt4 from anti-HIV_cap256-048-090756_VR-Chain
caggugcagcugguggagagcggcggcggcguggugagacccggcagaagccugagacugagcugcgccgugagcggcuucaccuucagcaacuacgccauccacugggugagacaggcccccggcaagggccuggaguggguggccgugaucagcuacgacggcagcgacaaguacuacgccgacagcgugaagggcagauucaccaucagcagagagaacagcaagaacaugcuguaccugcagaugaacagccugagaggcgaggacaccgccguguacuacugcgccaaggaccugagagaguucgagugcgaggagugggccagcgacuacuacgacuucggcagagacuaccccugccaggaccccagaggcguggugggcaccuucgacguguggggccacggcagccuggugaccgugagcagc

SEQ ID NO: 32728 - RNA, 432 nt, Artificial Sequence
  derived and/or modified sequence opt4 from anti-HIV_cap256-048-089065_VR-Chain
caggugcagcugguggagagcggcggcggcguggugcagcccggcagaagccugagacugagcugcgccgccagcggcuucaccuucagcaccuacgccaugcacugggugagacaggcccccggcaagggccuggaguggguggcccugaucagcuacgacggcaccaacaaguacuacguggacagcgugaagggcagauucaccaucagcagagacaacagcaagaacacccuguaccugcagaugaacagccugaccgccgaggacaccgccguguacuacugcgccaaggaccugggcggcaacaaggacgacgaguggggcaccgacuacuacgacuucagcguggccuaccccgugcaggaccccagagccgugagcggcaucuucgacguguggggccacggcaccauggugaccgugagcagc

SEQ ID NO: 32729 - RNA, 432 nt, Artificial Sequence
  derived and/or modified sequence opt4 from anti-HIV_cap256-048-084986_VR-Chain
caggugcagcugguggagagcggcggcggcguggugcagcccggcagaagccugagacugagcugcgccgccagcggcuucaccuucagcgacuacgccaugcacugggugagacaggcccccggcaagggccuggaguggguggcccugaucagcuacgacggcagcaacaaguacuacgccgacagcgugaagggcagauucaccaucagcagagacaacagcaagaacacccuguaccugcagaugagcagccugaccgccgaggacaccgccguguacuacugcgccaaggaccugggcggcaacaagaacgacgagugggccaccgacuacuacgaccugagcaucgccuaccccauccacgaccccagagccgugcugggcgccuucgacguguggggccagggcaccaugcugaccgugagcagc

SEQ ID NO: 32730 - RNA, 432 nt, Artificial Sequence
  derived and/or modified sequence opt4 from anti-HIV_cap256-048-083355_VR-Chain
caggugcagcugguggagagcggcggcggcguggugcagcccggcagaagccugagacugagcugcgccgugagcggcuucaucuucagcagcuacgccaugagaugggugagacaggcccccggcaagggccuggaguggguggccgugaucagcuacgacggcagcaagaccaacuacgccgacagcgugaagggcagauucaccaucagcagagacaacagcaagaacacccuguaccugcagaugaacagccugaccagcgaggacaccgccguguacuacugcgccaaggaccugggcggcagcaagaccgacgaguggggcaccgacuacuacgaguucuggaacgccuaccccgugcaggaccccagagugguggugggcgccuucgacaucuggggccacggcaccauggugaccgugagcagc

SEQ ID NO: 32731 - RNA, 432 nt, Artificial Sequence
  derived and/or modified sequence opt4 from anti-HIV_cap256-048-082462_VR-Chain
caggugcaccugguggagagcggcggcggcguggugcagcccggcaagagccugagacugagcugcaccgccagcagauucaucuucagaaacuacgccauggacugggugagacaggcccccggcaagggccuggaguggguggccgugaucagcuacgacggcgugaaggagcacuacgccgagagcgugaagggcagauucaccaucagcagagacaacagcaagaacaccguguaccugcagaugaacagccugagaguggaggacaccgccguguacuacugcgccaaggaccugggcgccaacaaggacgacgagugggccaccgacuacuacgaccugagcguggccuaccccgugcccgaccccagagccguggugggcgccuucgacguguggggccagggcaccauggugaccgugagcagc

SEQ ID NO: 32732 - RNA, 432 nt, Artificial Sequence
  derived and/or modified sequence opt4 from anti-HIV_cap256-048-082246_VR-Chain
caggugcaccugguggagagcggcggcggcguggugcagcccggcagaagccugagaaucagcugcgccgccagcggcuucaccuucagcaagaacgccaugcacugggugagacaggcccccggcaagggccuggaguggguggccuucguggccuucgacgagagcgacaaguacuacgccgacagcgugaagggcagauucaccaucagcagagacaacagcaagaacauccugagccugcagaugaacagccugagagccgaggacaccgccguguacuacugcgccaaggagguggacgaguacaaggacgacgagugggccagcgacuacuacgaccugagcaucgccuaccccgugagagaccccagagccguggugggcggcuucgacaucuggggccagggcaccauggugaccgugagcgcc

SEQ ID NO: 32733 - RNA, 432 nt, Artificial Sequence
  derived and/or modified sequence opt4 from anti-HIV_cap256-048-080752_VR-Chain
caggugcagcugguggagagcggcggcggcguggugcagcccggcggcagccugagacugagcugcgccgccagcggcuucaccuucagcaacuacggcaugcacugggugagacaggcccccggcaagggccuggaguggguggccuucaucagauacgacggcgacaucaccuacuacguggacagcgugaagggcagauucaccaucagcagagacaacagcaagaacgcccuguaccugcagaugaacagccugagagccgaggacaccgcccuguacuacugcgccaaggaccugagagaguacgagugcgaggagugggccagcgacuacuacgacuucggcagagaguaccccugccaggaccccagaggcguggugggcaccuucgacaucuggggccagggcaccauggugaccgugagcagc

SEQ ID NO: 32734 - RNA, 435 nt, Artificial Sequence
  derived and/or modified sequence opt4 from anti-HIV_cap256-048-078409_VR-Chain
caggugcagcugguggagagcggcggcggcguggugcagcccggcagaagccugagacugagcugcgccgccagcggcuucaccuucaacaacuacgccauggacugggugagacaggcccccggcaagggccuggaguggguggcccugaucagcuacgacggcagcaacaaguacuacgccgagagcgugaagggcagauucaccaucagcagagacaacagcaagaacacccuguaccugcagaugaacagccugagagccgaggacaccgccguguacuacugcgccaaggacgugggcgagaagcagagcaugaugagaugggccaccgacuacuacgaccugagcaucgccuaccccgugcccgaccccagagccguggugggcgccuucgaccuguggggcagaggcaccauggugaccgugagcagc

SEQ ID NO: 32735 - RNA, 432 nt, Artificial Sequence
  derived and/or modified sequence opt4 from anti-HIV_cap256-048-078273_VR-Chain
gaggugcagcugguggagagcggcggcggccuggugcagcccggcggcagccugagacugagcugcgccgccagcggcuucaccgugagcagcaacuacaugagcugggugagacaggcccccggcaagggccuggaguggguggccgugaucagcagcgacggcagcaacaagaacuacgccgacagcgugaagggcagauucaccaucagcagagacaacagcaagaacacccuguuccugcagaugaacagccugagacccgaggacaccgccguguacuucugcgccaaggaccugggcgccaacaaggacgacgagugggccaccgacuacuacgaccugagcaucgccuaccccgugcacgaccccagagccguggugggcaucuucgaccuguggggccagggcaccauggugaccgugagcagc

SEQ ID NO: 32736 - RNA, 432 nt, Artificial Sequence
  derived and/or modified sequence opt4 from anti-HIV_cap256-048-078062_VR-Chain
gacguguaccugguggagagcggcggcggccuggugcagcccggcggcagccugagacugagcugcaccgccagcggcaucaccuucagcaccuacgagaugaacugggugagacaggcccccggcaagggccuggaguggguggccuucguggccuucgacggcagcgacaaguacuacgccgacagcgugaagggcagauucgugaucagcagagacaacagcaagaacacccugagccugcagaugaacagccugagagccgaggacaccgccguguacuacugcgccaaggaggugggcgaggacaaggacgacgagugggccagcgacuacuacgaccugagcaucgccuaccccgugcacgaccccagagccguggugggcggcuucgacaucuggggccagggcaccauggugaccgugagcagc

SEQ ID NO: 32737 - RNA, 432 nt, Artificial Sequence
  derived and/or modified sequence opt4 from anti-HIV_cap256-048-077798_VR-Chain
caggugcagcugguggagagcggcggcggcguggugcagcccggcagaagccugagacugagcugcgccgccagcggcuucaccuucagcaacuacggcaugcacugggugagacagacccccggcaagggccuggaguggguggccgugaucagcuacgacggcagcaacaaguucuacgccgacagcgugaagggcagauucaccaucagcagagacaacagcaagaacacccuguaccugcagaugaacagccugagaguggaggacaccgccguguaccacugcgccaaggaccugggcggcagcaagagcgacgagugggccaccgacuacuacgacuggagcaucgccuaccccgugcacgaccccagagccguggugggcguguucgacaucuggggccagggcacccuggugaccgugagcagc

SEQ ID NO: 32738 - RNA, 432 nt, Artificial Sequence
  derived and/or modified sequence opt4 from anti-HIV_cap256-048-073853_VR-Chain
gaggugcagcugguggagagcggcggcggccuggugaagcccggcggcagccugagacugagcugcgccgccagcggcuucaccuucagcgacgccuggaugaacugggugagacaggcccccggcaagggccuggaguggguggccggcaucagcuucgccggcaccaacaaguacuacgccgacagcgugaagggcagauucaccaucagcagagacaacagcaagaacacccuguaccugcagaugaacagccugagagccgaggacaccgcccuguacuacugcgccaaggacaugagagaguacgagugcgaggagugggccagcgacuacuacgacuucggcagagacuaccccugccaggaccccagaggcguggugggcaccuucgacaucuggggccagggcaccauggugaccgugagcagc

SEQ ID NO: 32739 - RNA, 435 nt, Artificial Sequence
  derived and/or modified sequence opt4 from anti-HIV_cap256-048-071661_VR-Chain
caggugcagcugguggagagcggcggcggcguggugcagcccggcagaagccugggccugagcugcgaggugagcggcuucaccuucagcgacuacuucaugagcuggaucagacaggcccccggcaagggccuggaguggguggccgugaucagccacgacggcaacaacaaguacuaccccgacagcgugcagggcagauucaccaucagcagagagaacagcaagaacacccuguaccugcagaugaacagccugaagcccgaggacaccgccguguacuucugcgccaaggaccugggcggcgagagcgagguggaggagugggccagcgacuacuacgacuucggcagagacauccccggccccgaccccagaggcguggugggcacccuggacaucuggggccacggcaccauggugaccgugagcagc

SEQ ID NO: 32740 - RNA, 432 nt, Artificial Sequence
  derived and/or modified sequence opt4 from anti-HIV_cap256-048-071360_VR-Chain
caggugcagcugguggagagcggcggcggcguggugcagcccggcagaagccugagacugagcugcgccgccagcggcuucacccugaccaacuacgccauggacugggugagacaggcccccggcaagggccuggaguggguggccgugaucagcagcgacggcagcaacaagaacuacgaggacagcgugaagggcagauucaccaucagcagagacaacagcaagaacacccuguaccugcagaugagcagccugagacccgaggacaccgccguguacuacugcgccaaggacgugggcgacaacaagagcgacgagugggccaccgacuacuacgacuucagcaucgccuaccccgugcccgaccccagagccguggugggcgccuucgaccuguggggccagggcaccauggugaccgugagcagc

SEQ ID NO: 32741 - RNA, 432 nt, Artificial Sequence
  derived and/or modified sequence opt4 from anti-HIV_cap256-048-070955_VR-Chain
gaggugcagcugguggagagcggcggcggccuggugcagcccggcggcagcgugagacugagcugcgccgugagcggcuucaccuucagcagcuacuggaugagcugggugagacaggcccccggcaagggccuggaguggguggccgugaucagcgacagcggcagcaacaaguacuacgccgacagcgugaagggcagauucaccaucagcagagacaacagcaagaacacccuguaccugcagaugaacagccugagagccgaggacaccgccguguacuucugcgccaaggaccugggcggcagagagaccgaggagugggccagcgacuacuacgacuucggcagagacuuccccggccaggaccagagagccguggccggcguguucgacauguggggccagggcaccauggugaccgugagcagc

SEQ ID NO: 32742 - RNA, 432 nt, Artificial Sequence
  derived and/or modified sequence opt4 from anti-HIV_cap256-048-070061_VR-Chain
gaggugcagcugcuggagagcggcggcggccuggugcagcccggcggcagccugagacugagcugcgccgccagcggcuucaccuucagcagcuacgccaugcacugggugagacaggcccccggcaagggccuggaguggguggccgugaccagcuacgacggcagcaacaaguacuacgccgacagcgugaagggcagauucaccaucagcagagacaacagcaagaacacccuguacaugcagaugaacagccugagagccgaggacaccgccguguacuacugcgccaaggaccagggcgagagcgagaaggaggagugggccagcgacuacuacgacuucggcagagacuaccccggcagagaccccagaagagugguggccaccuucgccaucuggggccagggcaccauggugaccgugagcagc

SEQ ID NO: 32743 - RNA, 432 nt, Artificial Sequence
  derived and/or modified sequence opt4 from anti-HIV_cap256-048-069669_VR-Chain
caggugcagcugguggagagcggcggcggcguggugcagcccggcagaagccugagacugagcugcgccgugagcggcuucaccuucagcaaguuccccaugcacugggugagacaggcccccggcaagggccuggaguggguggccgugaucagcuacgacggcaacaagaaguacuacguggacagcgccaagggcagauucaccaucagcagagacaacagcagaaagacccuguaccugcagaugaccggccugagacccgaggacaccgccguguacuacugcgccaaggaccugggcggcggcgagugcgagaccugggccagcgacuacuacgacuucggcaaggacuaccccugccuggaccccagagacguggugggcaccuucgacaucuggggccagggcacccuggugaccgugagcagc

SEQ ID NO: 32744 - RNA, 432 nt, Artificial Sequence
  derived and/or modified sequence opt4 from anti-HIV_cap256-048-069205_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggagugggugguggugaucagcaacgacggcaacaacaaguacuacgccgacagcgugaagggcagauucaccaucagcagagacaacagcaagaacaccguguaccugcagaugaacagccugagagccgaggacaccgccguguacuacugcgccaaggacgugggcgacaccaagaaggacgagugggccaccgacuacuacgaccugagcaucgccuaccccgugcaggacccccaggccguggugggcgccuucgacaucuggggccagggcaccauggugaccgugagcagc

SEQ ID NO: 32745 - RNA, 432 nt, Artificial Sequence
  derived and/or modified sequence opt4 from anti-HIV_cap256-048-068882_VR-Chain
caggugcagcugguggagagcggcggcggcguggugcagcccggcagaagccugagacugagcugcgccgccagcggcuucaccuucagcaccuacgccaugcacugggugagacaggcccccggcaagggccuggaguggguggcccugaucagcuacgacggcaccgacaaguacuacgccgacagcgugaagggcagauucaccaucagcagagacaacagcaagaacaccguguaccugcagaugaacagccugagaggcguggacaccgccguguacuacugcgccaaggaccugggcggcggcgagguggaggagugggccaccgacuacuacgacuggagcaccgccuaccccguggagcaccccagagccguggugggcguguucgacaucuggggccagggcaccaaggugaccgugagcagc

SEQ ID NO: 32746 - RNA, 432 nt, Artificial Sequence
  derived and/or modified sequence opt4 from anti-HIV_cap256-048-067764_VR-Chain
gaggugcagcuggugcagagcggcggcggccuggugaagcccggcggcagccugagacugagcugcgccgccagcggcuucaccuucagcaccuacagcaugaacugggugagacaggcccccggcaagggccuggaguggguggccgugaucagcagcgacggcagcagcaagaacuacgccgacagcgugaagggcagauucaccaucagcagagacaacagcaagaacaccgugagccugcagaugaacagccugagacccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32747 - RNA, 432 nt, Artificial Sequence
  derived and/or modified sequence opt4 from anti-HIV_cap256-048-066845_VR-Chain
caggugcugcugguggagagcggcggcggcguggugcagcccggcggcagccugacccugagcugcgccgccagcggcuucaccuucagcaacuacggcaugcacugggugagacaggcccccggcaagggccuggaguggguggccuucaucagauacgacggcaacaacaaguacuacgccgacagcgugaagggcagauucaccaucagcagagacaacagcaaggacacccuguaccugcagauggacggccugagacccgaggacaccgcccuguacuacugcgccaaggaccugggcgagagagagugcgaggagugggccagcaacuacuacgacuucggcagagacuaccccugccaggaccccagaggcguggugggcaccuucgacaucuggggccagggcaccauggugaccgugagcagc

SEQ ID NO: 32748 - RNA, 432 nt, Artificial Sequence
  derived and/or modified sequence opt4 from anti-HIV_cap256-048-065226_VR-Chain
gaggugcagcugguggagagcggcggcggccuggugaagcccggcggcagccugagacugagcugcguggccagcggcuucaccuucagcaacuacggcaugcacugggugagacaggcccccggcaagggccugguguggguggccggcaucagcuucgccggcaccaacaaguacuacgccgccagcgugaagggcagauucaccaucagcagagacaacagcaagaacacccuguaccugcagaugaacagccugagagccgaggacaccgcccuguacuacugcgccaaggacaugagagaguacgagugcgaggagugggccagcgacuacuacgacuucggcagagacuaccccugccaggaccccagaggcguggugggcaccuucgacaucuggggccagggcaccauggugaccgugagcagc

SEQ ID NO: 32749 - RNA, 432 nt, Artificial Sequence
  derived and/or modified sequence opt4 from anti-HIV_cap256-048-063717_VR-Chain
caggugcagcugguggagagcggcggcggcguggugcagcccggcagaagccugagacugagcugcgccgccagcggcuucagcuucagcaaccacgccauggacugggugagacaggcccccggcaagggccuggaguggguggccgugaucagcagcgacggcagcgacaagaucuacgccgagagcgugaagggcagauucaccaucagcagagacaacagcaagaacacccuguaccugcagaugaacagccugagaguggaggacaccgccguguacuucugcgccaaggaccugggcgccaacaaggacgacgagugggccaccgacuacuacgaccugagcaucgccuaccccgugcccgaccccagagccguggugggcgccuucgacaucuggggccagggcaccauggugagcgugagcagc

SEQ ID NO: 32750 - RNA, 432 nt, Artificial Sequence
  derived and/or modified sequence opt4 from anti-HIV_cap256-048-063150_VR-Chain
gaggugcagcugguggagagcggcggcggcguggugcagcccggcagaagccugagacugagcugcgccgccagcggcuucaccuucagcagcuacgccaugcacugggugagacaggcccccggcaagggccuggaguggguggcccacaucagauacgacggcagcaacaaguacuacaucgacagcgugcagggcagauucaccaucagcagagacaaccccaagaacacccuguaccugcagaugaacagccugagaaccgaggacaccgccguguacuacugcgccaaggaccugggcggcggcgagguggaggagugggccaccgacuacuacgacuggagcaucgccuaccccguggagcaccccagagccguggugggcguguucgacaucuggggccagggcaccaaggugaccgugagcagc

SEQ ID NO: 32751 - RNA, 432 nt, Artificial Sequence
  derived and/or modified sequence opt4 from anti-HIV_cap256-048-062431_VR-Chain
caggugcagcugguggagagcggcggcggcguggugcagcccggcagaagccugagacugagcugcgccgccagcggcuucaccuucagcaacuucgccauggacugggugagacaggcccccggcaagggccuggaguggguggccgugaucagcagcgacggcagcaagaagaacuacggcgacagcgugaagggcagauucaccaucagcagagacaacagcaagaacacccuguuccugcagaugaacagccugagacccgaggacaccgcccuguacuacugcgccaaggaccugggcggcuacaagagcgacgagugggccaccgacuacuacgaccugagcaucgccuaccccgugcaggaccccagacccuggcuggagcugcuguacaucuggggccagggcgccauggugaccgugagcagc

SEQ ID NO: 32752 - RNA, 432 nt, Artificial Sequence
  derived and/or modified sequence opt4 from anti-HIV_cap256-048-060745_VR-Chain
caggugcagcugguggagagcggcggcagcguggugcagcccggcagaagccugagacugaccugcaccgccagcggcuucaccuucagccacuacgccauggacugggugagacaggcccccggcaagggccuggaguggguggccgugaucagcagcgacgccaccaacaagaacuacgccgacagcgugaagggcagauucaccaucagcagagacaacagcaagaacaccguguaccugcagauggacagccugagagccgaggacaccgccguguacuacugcgccaaggacgugggcgacuacaaggacgacgagugggccaccgacuacuacgacuucagcaucgccuaccccgugcccgaccccagagccguggugggcgccuucgacuucuggggccagggcaccauggugaccgugagcagc

SEQ ID NO: 32753 - RNA, 432 nt, Artificial Sequence
  derived and/or modified sequence opt4 from anti-HIV_cap256-048-060420_VR-Chain
caggugcagcugguggagagcggcggcggcguggugcagcccggcagaagccugagacugagcugcgccgccagcggcuucaccuucagcagcuacggcauggccugggugagacaggcccccggcaagggccuggagugggugaccgugaucagcuucgccggcgugaagaaguacuacgccgacagcgugaagggcagauucaccaucagcagagacaacagcaagggcacccuguaccugcagaugaacagccugagagccgaggacaccgccguguacuacugcgccaaggacgugggcgacaccaagaaggacgagugggccaccgacuacuacgaccugagcaucgccuaccccgugcaggacccccaggccguggugggcgccuucgacaucuggggccagggcaccauggugaccgugagcagc

SEQ ID NO: 32754 - RNA, 435 nt, Artificial Sequence
  derived and/or modified sequence opt4 from anti-HIV_cap256-048-060014_VR-Chain
caggugcagcugguggagagcggcggcggcguggugcagcccggcagaagccugagacugagcugcgccgccagcggcuucaccuucagcaacuacggcaugcacugggugagacaggcccccggcaagggccuggaguggguggcccugaucagccacgacggcagcaacaagaacuucgccgacagcgugaagggcagauucaccaucagcagagacaacagcaagaacacccuguaccugcagaugaacagccugagaaccgaggacaccgccaucuacuacugcgccaaggaccugggcggcgagagcgagaucgaggaguggcccagcgacuacuacgacuucggcagagacuaccccgugcccgaccccagaggcguggugggcaccuucgacuucuggggccagggcaccauggugaccgugagcagc

SEQ ID NO: 32755 - RNA, 432 nt, Artificial Sequence
  derived and/or modified sequence opt4 from anti-HIV_cap256-048-059747_VR-Chain
caggugcagcugguggagagcggcggcggcguggugcagcccggcagaagccugagacugagcugcgccgccagcggcuucaccuucacccacuacgccauggacugggugagacaggcccccggcaagggccuggaguggguggccgugaucagcagcgacggcagcagcaaggacuacgccgacagcgugaagggcagauucaccaucagcagagacaacagcaagaacacccugagccugcagaugaacagccugagacccgaggacaccgccguguacuacugcgccaaggaccugggcgccagcaaggacgacgagugggccaccgacuacuacgaccugagcaucgccuaccccgugcacgaccccagagccguggugggcggcuucgacaucuggggccagggcaccauggugaccgugagcagc

SEQ ID NO: 32756 - RNA, 432 nt, Artificial Sequence
  derived and/or modified sequence opt4 from anti-HIV_cap256-048-058393_VR-Chain
caggugcagcugguggagagcggcggcggcguggugcagcccggcggcagccugagacugagcugcgccgccagcggcuucaccuucaacaccuacggcaugcacugggugagacaggcccccggcaagggccuggagugggugaccuucaucagauacgacggcagcaacgaguacuacgccgacagcgugaagggcagauucaccaucagcagagacaacagcaagaacacccuguaccugcagaugaacagccugagcguggaggacaccgccguguacuacugcgccaaggaccugggcaagaacaaggacgacgagugggccaccgacuacuacgacaucagcaucgccuaccccgugcccgaccccagagccguggugggcguguucgacaucuggggccagggcaccguggugaccgugagcagc

SEQ ID NO: 32757 - RNA, 432 nt, Artificial Sequence
  derived and/or modified sequence opt4 from anti-HIV_cap256-048-058159_VR-Chain
caggugcagcugguggagagcggcggcggcguggugcagcccggcagaagccugagacugagcugcgccgccagcggcuucaccuucagcagcuaccccaugcacugggugagacaggcccccggcaagggccuggaguggguggccgugaucagcuucgccggcaccaacaaguacuacgcccacagcgugaagggcagauucaccaucagcagagacaacagcaagaacacccuguaccugcagaugaacagccugagagccgaggacaccgcccuguacuacugcgccagagaccugagagagagcgagugcgaggagugggccagcgacuacuacgacuucggcagagaguaccccugccaggaccccagaggcguggugggcaccuucgacaucuggggcagaggcaccauggugaccgugagcagc

SEQ ID NO: 32758 - RNA, 432 nt, Artificial Sequence
  derived and/or modified sequence opt4 from anti-HIV_cap256-048-057127_VR-Chain
gacguguaccugguggagagcggcggcggccuggugcagcccggcggcagccugagacugagcugcguggccagcggcaucaccuucagcagcuacggcaugcacugggugagacaggcccccggcaagggccuggagugggccgccuucaucagauacgacggcagaaacaaguacuacgccgacagcgugaagggcagauucaccaucagcagagacaacagcaagaacacccugagccugcagaugaacaaccugagagccgaggacaccgccguguacuacugcgccaaggaggugggcgacaacaaggacgacgagugggccagcgacuacuacgaccugagcaucgccuaccccgugcaggaccccagagccguggugggcggcuacgacaucuggggccagggcaccauggugaccgugagcagc

SEQ ID NO: 32759 - RNA, 432 nt, Artificial Sequence
  derived and/or modified sequence opt4 from anti-HIV_cap256-048-056251_VR-Chain
gaggugcagcugguggagagcggcggcggccuggugcagcccggcagaagccugagacugagcugcgccggcagcggcuucaccuucagcaacuucggcuuccacugggugagacaggcccccggcaagggccuggaguggguggccgccaucagcuucgccggcuacaacaaguacuacgccgacagcgugaagggcagauucaccaucagcagagagaacagcaacaacaugcuguaccugcagaugagcagccugagagccgaggacaccgccguguacuacugcgccaaggaccugagagagagcgagugcgaggagugggccagcgacuacuacgacuucggcaaggacuaccccugccaggaccccagaggcguggugggcaccuucgacguguggggccacggcagccuggugaccgugagcagc

SEQ ID NO: 32760 - RNA, 432 nt, Artificial Sequence
  derived and/or modified sequence opt4 from anti-HIV_cap256-048-055421_VR-Chain
caggugcagcugguggagagcggcggcggcguggugcagcccgccagaagccugagacugagcugcgccgccagcggcuucaucuucagcaccuacggcaugcacugggugagacaggcccccggcaagggccuggaguggguggccgugaucagcagcgacggcagcagcaaggacuacgccgacagcgugaagggcagauucaccaucagcagagacaacagcaagaacacccugagccugcagaugaacagccugagacccgaggacaccgccguguacuacugcgccaaggaccugggcgccagcaaggacgacgagugggccaccgacuacuacgacuucagcaucgccuaccccgugcaggaccccagagccguggugggcgccuucgacaucuggggccagggcaccauggugaccgugagcagc

SEQ ID NO: 32761 - RNA, 432 nt, Artificial Sequence
  derived and/or modified sequence opt4 from anti-HIV_cap256-048-054989_VR-Chain
caggugcagcugguggagagcggcggcggcguggugcagcccggcggcagccugagacugagcugcgccgccagcggcuucaccuucagcaccaacggcaugcacugggugagacaggcccccggcaagggccuggaguggguggccuucaucagauacgacggcagcaacaaguacuacgccgacagcgugaagggcagauucaccaucagcagagacaacagcaagaacaccguguaccugcagaugaacagccugagaggcguggacaccgccguguacuacugcgccaaggaccugggcggcggcgagguggaggagugggccaccgacuacuacgacuggagcaucgccuaccccguggagcaccccagagccguggugggcguguucgacaucuggggccagggcaccaaggugaccgugagcagc

SEQ ID NO: 32762 - RNA, 435 nt, Artificial Sequence
  derived and/or modified sequence opt4 from anti-HIV_cap256-048-054759_VR-Chain
caggugcagcugguggagagcggcggcggcguggugcagcccggcagaagccugagacugagcugcgccgccagcggcuucagcuucagcaagaacggcaugcacugggugagacaggcccccggcaagggccuggaguggguggccuucguggccuucgacgagagcgacaaguacuacgccgacagcgugaagggcagauucaccaucagcagagacaacagcaagaacacccugagccugcagaugaacagccugagaguggaggacaccgccguguacuacugcgccaaggaggugggcgagaacaaggacgacgagugggccgcccccgacuacuacgacuucagcaucgccuaccccgugcaggaccccagagccguggugggcggcuucgacaucuggggccagggcaccauggugaccgugagcagc

SEQ ID NO: 32763 - RNA, 432 nt, Artificial Sequence
  derived and/or modified sequence opt4 from anti-HIV_cap256-048-052573_VR-Chain
caggugaagcugguggagagcggcggcggcguggugcagcccggcagaagccugagacugagcugcgccgccagcggcuucagcuucagcaacuacgccauggacugggugagacaggcccccggcaagggccuggaguggguggccguggugagcagcgacggcagcaacaagaacuacgccgacagcgugaagggcagauucaccaucagcagagacaacagcaagaacaccguguaccugcagaugaacagccugagagccgaggacaccgccguguacuacugcgccaaggaccugggcgccaacaaggacgacgagugggccaccgacuacuacgacuggagcaucgccuaccccgugcacgaccccagagccguggugggcguguucgacaucuggggccagggcacccuggugaccgugagcagc

SEQ ID NO: 32764 - RNA, 432 nt, Artificial Sequence
  derived and/or modified sequence opt4 from anti-HIV_cap256-048-051477_VR-Chain
caggagcagcugguggagagcggcggcggcguggugcagcccggcagaagccugagacugagcugcgccgccagcggcuucaccuucagcaacuacgccaugcacugggugagacaggcccccggcaagggccuggaguggguggccgccaugagccacgacggcagcgacaaguacuacgccgacagcgugaagggcagauucaccaucagcagagacaacagcaagaacacccuguacaugcagaugaacagccugagagccgaggacaccgccguguacuacugcgccaaggaccagggcgagagcgagaaggaggagugggccagcgacuacuacgaccugagcaucgccuaccccauccaggaccccagagccauggugggcgccuucgacaucuggggccagggcaccauggugaccgugagcagc

SEQ ID NO: 32765 - RNA, 432 nt, Artificial Sequence
  derived and/or modified sequence opt4 from anti-HIV_cap256-048-051299_VR-Chain
caggugcagcugguggagagcggcggcggcguggugcagcccggcagaagccugagacugagcugcgccgccagcggcuucaccuucagcaccuucggcaugcacugggugagacaggcccccggcaagggccuggaguggguggcccugaucagccacgacggcaacaacaaguacuacgccgacagccugaagggcagauucaccaucagcagagagaacagcaagaacacccuguuccugcagaugaacagccugagagccgaggacaccagcguguacuacugcgccaaggaccugggcgacagcgagugcgaggagugggccagcgacuacuacgacuucggcaaggacuaccccugccugcaccccagaggcguggugggcaccuucgacuucuggggccacggcaccauggugaccgugagcagc

SEQ ID NO: 32766 - RNA, 432 nt, Artificial Sequence
  derived and/or modified sequence opt4 from anti-HIV_cap256-048-050815_VR-Chain
caggugcagcugguggagagcggcggcggcguggugcagcccggcggcagccugagacugagcugcguggugagcggcuucaccuucagcagcuacggcaugcacugggugagacaggcccccggcaagggccuggagugggugagcuucaucagauucgacggcaacuacgaguacuacguggacagcgugaagggcagauucaccaucagcagagacaacagcaagaacaccguguaccugcagauggacagccugagagccgaggacaccgccguguacuacugcgccaaggacgugggcgacuacaaggacgacgagugggccaccgacuacuacgacuucagcaucgccuaccccgugcccgaccccagagccguggugggcgccuucgacuucuggggccagggcaccauggugaccgugagcagc

SEQ ID NO: 32767 - RNA, 432 nt, Artificial Sequence
  derived and/or modified sequence opt4 from anti-HIV_cap256-048-049884_VR-Chain
caggugcagcugguggagagcggcggcggcguggugcagcccggcagaagccugagacugagcugcgccgccagcggcuucagcuucaacaccuacgccaugcacugggugagacaggcccccggcaagggccuggaguggauggcccugaucagcuacgacggcagcaacaaguacuacguggacagcgugaagggcagauucaccaucagcagagacaacagcaagaacacccuguaccugcagaugaacagccugagagccgaggacaccgccguguacuacugcgccaaggaccugggcggcaacaaggacgacgagugggccaccgacuacuacgaccugagcaucgccuaccccgugcaggaccccagagugguggugggcaucuucgacaucuggggccagggcaccauggugaccgugagcagc

SEQ ID NO: 32768 - RNA, 432 nt, Artificial Sequence
  derived and/or modified sequence opt4 from anti-HIV_cap256-048-049170_VR-Chain
caggugcagcugguggagagcggcggcggcguggugcagcccggcagaagccugagacugagcugcgccgccagcggcuucaucuucagcagcuacggcaugcacugggugagacaggcccccggcaagggccuggaguggguggccgugaucagcggcgacggcaccaagaaggacuucgccgacagcgugaagggcagauucaccaucagcaaggacaacagcaagaacauggugagccugcagaugaacagccugagagccgaggacgccgccguguacuacugcgccaaggaccugggcgagagcgacaacgaggaguggcccagcgacuacuacgacuucggcagagacuucaccggccagaaccccagagccguggugggcaccuucgaccuguggggccagggcaccauggugaccgugagcagc

SEQ ID NO: 32769 - RNA, 435 nt, Artificial Sequence
  derived and/or modified sequence opt4 from anti-HIV_cap256-048-048531_VR-Chain
caggugcagcugguggagagcggcggcggcguggugcagcccggcagaagccugagacugagcugcgccgccagcggcuucaccuucagcagcuacggccugcacugggugagacaggcccccggcaagggccuggaguggguggccuucaucagcuacgacggcaacaacaagcacuacguggacagcgugaagggcagauucaccaucagcagagacaacagcaagaacacccuguaccugcagaugaacagccugagagccgaggacaccgccguguacuacugcgccaaggaccugggcggcgagagcgagaucgaggagugggccaccgacuacuacgacuucagcaucgccuaccccgugaaggagagcagaggcguggugggcaucuucgacauguggggccagggcaccauggugaccgugagcagc

SEQ ID NO: 32770 - RNA, 432 nt, Artificial Sequence
  derived and/or modified sequence opt4 from anti-HIV_cap256-048-048259_VR-Chain
caggugcagcugguggagagcggcggcggcguggugcagcccggcagaagccugagacugagcugcgccgccagcggcuucaccuucagcaccugcgccaugcacugggugagacaggcccccggcaagggccuggaguggguggccgugaucagcuacgacggcagcaacaaguacuacguggacagcgugaagggcagauucaccaucagcagagacaacagcaagaacacccuguaccugcagaugaacagccugagagccgaggacaccgccguguacuacugcgccaaggagguggacaucaacaaggaggacgagugggccagcgacuacuacgacuucagcaucgccuaccccgugcaggaccccagagccguggugggcggcuucgacaucuggggccagggcaccauggugaccgugagcagc

SEQ ID NO: 32771 - RNA, 432 nt, Artificial Sequence
  derived and/or modified sequence opt4 from anti-HIV_cap256-048-047313_VR-Chain
caggugcagcugguggagagcggcggcggcguggugcagcccggcagaagccugagacugagcugcgccgccagcggcuucaccuucagcaccuucggcaugcacugggugagacaggcccccggcaagggccuggaguggguggccgugaucagccacgacggcaacaacaaguacuacgccgacagcgugaagggcagauucaccaucagcagagacaacagcaagaacaccguguaccugcagaugaacagccugagagccgaggacaccgccguguacuacugcgccaaggaccugggcgccaacaaggacgacgagugggccaccgacuacuacgaccugagcguggccuaccccgugcccgaccccagagccguggugggcgccuucgacguguggggccagggcaccauggugaccgugagcagc

SEQ ID NO: 32772 - RNA, 432 nt, Artificial Sequence
  derived and/or modified sequence opt4 from anti-HIV_cap256-048-046596_VR-Chain
caggugcagcugguggagagcggcggcggcguggugcagcccggcggcagccugagacugagcugcgccgccagcggcuucaccuucagcagcuacggcaugcacugggugagacaggcccccggcaagggccuggaguggguggccuucaugagauucgacggcagcaacagauacuacggcgacagcgugaagggcagauucaccaucagcagagacaacagcaagaacacccuguaccugcagaugaacagccugagaaccgaggacgccgcccuguacuacugcgccaaggacaugagagaguucgagugcgaggagugggccagcgacuacuacgacuucggcagagacuaccccugccaggaccccagaggcguggugggcaucuucgacaucuggggccagggcaccauggugaccgugagcagc

SEQ ID NO: 32773 - RNA, 432 nt, Artificial Sequence
  derived and/or modified sequence opt4 from anti-HIV_cap256-048-044781_VR-Chain
caggugcagcugguggagagcggcggcggcguggugcagcccggcagaagccugagacugagcugcgccgccagcggcuucaccuucaccagcuacgccauccacugggugagacaggcccccggcaagggccuggaguggguggccgugaucagcuacgacggcagcaagaagaacuacgccgacagcgugaagggcagauucaccaucagcagagacaacagcaagaacacccuguacgugcagaugaacagccugagagccgaggacaccgccguguacuacugcgccaaggaggugggcgaggacaaggacgacgagugggccagcgacuacuacgaccugagcaucgccuaccccgugcacgaccccagagccguggugggcggcuucgacaucuggggccagggcaccauggugaccgugagcagc

SEQ ID NO: 32774 - RNA, 432 nt, Artificial Sequence
  derived and/or modified sequence opt4 from anti-HIV_cap256-048-042599_VR-Chain
caggugcagcugguggagagcggcggcggcguggugcagcccggcagaagccugagacugagcugcgccgccagcggcuucaccuucagcaacuacggcaugcacugggugagacagacccccggcaagggccuggaguggguggccgugaucagcuacgacggcagcaacaaguucuacgccgacagcgugaagggcagauucaccaucagcagagacaacagcaagaacacccuguaccugcagaugagcagccugagagccgacgacaccgccguguacuacugcgccaaggaggugggcgaggacaaggacgacgagugggccagcgacuacuacgaccugagcaucgccuaccccgugcacgaccccagagccguggugggcggcuucgacaucuggggccagggcaccauggugaccgugagcagc

SEQ ID NO: 32775 - RNA, 432 nt, Artificial Sequence
  derived and/or modified sequence opt4 from anti-HIV_cap256-048-041276_VR-Chain
caggugcagcugguggagagcggcggcggcguggugcagcccggcagaagccugagacugagcugcgccgccagcagauucaccuucagcagcuacgccaugcacugggugagacaggcccccggcaagggccuggaguggguggccaucaucagcuacgacggcagcaacaaguacuacgccgacagcgugaagggcagauucaccaucagcagagacaacagcaagaacacccuguuccugcagaugaacagccugagagccgaggacaccgcccuguacuacugcgccaaggaccugggcggcuacaagagcgacgagugggccaccgacuacuacgaccugagcaucgccuaccccauccaggaccccagagccguggugggcgccuucgacaucuggggccagggcaccauggugaccgugagcagc

SEQ ID NO: 32776 - RNA, 432 nt, Artificial Sequence
  derived and/or modified sequence opt4 from anti-HIV_cap256-048-040200_VR-Chain
caggugcagcugguggagagcggcggcggcguggugcagcccggcagaagccugagacugagcugcguggccagcggcuucaccuucagcagcuucggcaugcacugggugagacaggcccccggcaagggccuggaguggguggccgugaucagccacgacggccacaacaaguacuacgccgacagccugaagggcagauucaccgugagcagagagaacagcaagaacacccuguuccugcagaugaacagccugagagccgaggacaccagcguguacuacugcgccaaggaccugggcggcggcgagugcgaggagugggccagcgacuacuacgacuucggcagagacuaccccugccugacccccagaggcguggugggcaccuucgacaucuggggccacggcaccaccgugaccgugagcagc

SEQ ID NO: 32777 - RNA, 432 nt, Artificial Sequence
  derived and/or modified sequence opt4 from anti-HIV_cap256-048-039061_VR-Chain
gaggugcagcugcugggcagcggcggcggccuggugcagcccggcggcagccugagacugaccugcgccgugagcggcuucaccuucagcagcuucgccaugagcugggugagacaggcccccggcaagggccuggaguggguggcccugaucagcuacgacggcaccgacaaguacuacgccgacagcgugaagggcagauucaccaucagcagagacaacagcaagaacacccuguaccugcagaugaacagccugagaguggaggacaccgccaucuaccacugcgccaaggaccugggcggcaccaagagcgacgagugggccaccgacuacuacgaccugagcaucgccuaccccauccaggaccccggcgccguggugggcguguucgacaucuggggccagggcaccauggugaccgugagcagc

SEQ ID NO: 32778 - RNA, 432 nt, Artificial Sequence
  derived and/or modified sequence opt4 from anti-HIV_cap256-048-038515_VR-Chain
caggugcagcugguggagagcggcggcggcguggugcagcccggcagaagccugagacugagcugcgccgccagcggcuucaccuucagcaccuacgccaugcacugggugagacaggcccccggcaagggccuggagugggugguggugaucagcuacgacggcagcaacaaguacuacgccgacagcgugaagggcagauucaccaucagcagagacaacagcaagaacacccuguuccugcagaugaacagccugagagccgaggacaccgcccuguacuacugcgccaaggacgugggcgaguacaagagcgacgagugggccaccgacuacuacgaccugagcaucgccuaccccauccaggaccccagagccauggugggcgccuucgacaucuggggccagggcaccauggugaccgugagcagc

SEQ ID NO: 32779 - RNA, 432 nt, Artificial Sequence
  derived and/or modified sequence opt4 from anti-HIV_cap256-048-038255_VR-Chain
caggugcagcugguggagagcggcggcggcguggugcagcccggcagaagccugagacugagcugcgccgccagcggcuucacccugagcagcuacgccaugcacugggugagacaggcccccggcaagggccuggaguggguggccgugaucagcuacgacggcagcaacaaguacuacgccgacagcgugaagggcagauucaccaucagcagagacaacagcaagaacgcccuguaccugcagaugaacagccugagagccgaggacaccgcccuguacuacugcgccaaggaccugagagaguacgagugcgaggagugggccagcgacuacuacgacuucggcagagacuaccccugccaggaccccagaggcguggugggcaccuucgacaucuggggccagggcaccauggugaccgugagcagc

SEQ ID NO: 32780 - RNA, 432 nt, Artificial Sequence
  derived and/or modified sequence opt4 from anti-HIV_cap256-048-038177_VR-Chain
caggugcagcugguggagagcggcggcggcguggugcagcccggcagaagccugagacugagcugcgccgccagcggcuucaccuucaacaccuacggcauccacugggugagacaggcccccggcaagggccuggaguggguggcccugaucagcuacgacggcaccgacaaguacuacgccgacagcgugaagggcagauucaccaucagcagagacaacagcaagaacacccuguaccugcagaugaacagccugagaguggaggacaccgccaucuaccacugcgccaaggaccugggcggcaccaagagcgacgagugggccaccgacuacuacgaccugagcaucgccuaccccauccaggaccccggcgccguggugggcguguucgacaucuggggccagggcaccauggugaccgugagcagc

SEQ ID NO: 32781 - RNA, 432 nt, Artificial Sequence
  derived and/or modified sequence opt4 from anti-HIV_cap256-048-035513_VR-Chain
caggugcagcugguggagagcggcggcggcguggugcagcccggcagaagccugagacugagcugcgccgccagcggcuucaccuucagcagcuacggcauggccugggugagacaggcccccggcaagggccuggagugggugaccgugaucagcuucgccggcgugaagaaguacuacgccgacagcgugaagggcagauucaccaucagcagagacaacagcaagggcacccuguaccugcagauggacggccugagacccgaggacaccgcccuguacuacugcgccaaggaccugggcgagagagagugcgaggagugggccagcgacuacuacgacuucggcagagacuuccccugccaggaccccagaggcguggugggcaccuucgacaucuggggccagggcaccauggugaccgugagcagc

SEQ ID NO: 32782 - RNA, 432 nt, Artificial Sequence
  derived and/or modified sequence opt4 from anti-HIV_cap256-048-034112_VR-Chain
cagaugcagcugguggagagcggcggcggcguggugcagcccggcagaagccugagacugagcugcgccgccagcggcuucaccuucaacagcuacgccaugcacugggugagacaggcccccggcaagggccuggaguggguggccgugaucagcuacgacggcagcaacaaguacuacgccgacagcgugaagggcagauucaccaucagcagagacaacagcaagaacaccguguaccugcagaugaacagccugagaggcguggacaccgccguguacuacugcgccaaggaccugggcggcggcgagguggaggagugggccaccgacuacuacgacuggagcaucgccuaccccguggagcaccccagagccguggugggcguguucgacaucuggggccagggcaccaaggugaccgugagcagc

SEQ ID NO: 32783 - RNA, 432 nt, Artificial Sequence
  derived and/or modified sequence opt4 from anti-HIV_cap256-048-033983_VR-Chain
caggugcagcugguggagagcggcggcggcguggugcagcccggcgagagccugagacugagcugcgccgccagcggcuucacccugagcagccacggcauccacugggugagacaggcccccggcaagggccuggaguggguggccuucaucagcagcgacggcagcaacaagaacuacggcgacagcgugaagggcagauucaccaucagcagagacaacagcaagaacacccuguuccugcagaugaacagccugagagccgaggacaccgcccuguacuacugcgccaaggacgugggcgaguacaagagcgacgagugggccaccgacuacuacgaccugagcaucgccuaccccauccaggaccccagagccauggugggcgccuucgacaucuggggccagggcaccauggugaccgugagcagc

SEQ ID NO: 32784 - RNA, 432 nt, Artificial Sequence
  derived and/or modified sequence opt4 from anti-HIV_cap256-048-032688_VR-Chain
caggugcagcugguggagagcggcggcggcguggugcagcccggcagaagccugagacugagcugcgccgccagcggcuucaucuucaacagcuacggcaugcacugggugagacaggcccccggcaagggccuggaguggguggccguggugcacggcgacggcggcaacaaguacuacgccgacagcgugaagggcagauucaccaucagcagagacaacagcaagaacacccuguaccuggagaugaacagccugagagccgaggacaccgccgaguacuacugcgccaaggaccugggcgagagcgacaaggaggaguggcccagcgacuacuacgacuucggcagagacuucaccggccaggugcccagagccguggugggcgccuucgacaucuggggccagggcaccauggugaccgugagcagc

SEQ ID NO: 32785 - RNA, 432 nt, Artificial Sequence
  derived and/or modified sequence opt4 from anti-HIV_cap256-048-031092_VR-Chain
caggugcagcugguggagagcggcggcggcguggugcagcccggcagaagccugagacugagcugcgccgccagcggcuucagcuucuacaacuucgccauggacugggugagacaggcccccggcaagggccuggaguggguggccgugaucagcagcgacggcggcaacaagaacuacguggacagcgugaagggcagauucaccaucagcagagacaacagcaagaacacccuguaccugcagaugaacagccugagagccgaggacaccgccguguacuacugcgccaaggaccugggcggcaccaaggacgacgagugggccaccgacuacuacgacaucagcaucgccuaccccgugcaggaccccagagccguggccggcgccuucgacaucuggggccagggcaccauggugaccgugagcagc

SEQ ID NO: 32786 - RNA, 435 nt, Artificial Sequence
  derived and/or modified sequence opt4 from anti-HIV_cap256-048-030464_VR-Chain
caggugcagcugguggagagcggcggcggccuggugaagcccggcggcagccugagacugagcugcgaggccagcggcuucagcuucaccaacuacuacaugagcuggaucagacaggcccccggcaagggccuggaguggguggccgugaucagcuucaacggcagaaacaaguacuacgccgacuucgugaagggcagauucaccaucagcagagacaacagcaagaacacccugagccugcagaugaacagccugagaguggaggacaccgccguguacuacugcgccaaggaggugggcgagaacaaggacgacgagugggccgcccccgacuacuacgacuucagcaucgccuaccccgugcaggaccccagagccguggugggcggcuucgacaucuggggccagggcaccauggugaccgugagcagc

SEQ ID NO: 32787 - RNA, 432 nt, Artificial Sequence
  derived and/or modified sequence opt4 from anti-HIV_cap256-048-030289_VR-Chain
caggugcagcugguggagagcggcggcggcguggugcagcccggcggcagccugagacugagcugcgccgccagcggcuucaccuucagcagcuacggcaugcacugggugagacaggcccccggcaagggccuggaguggguggccuucaucagauacgacggcagcaacaaguacuacgccgacagcgugaagggcagauucaccaucagcagagacaacagcaagaacaccguguaccugcagaugaacagccugagaguggaggacaccgccguguacuacugcgccaaggaccugggcgccaacaaggacgacgagugggccaccgacuacuacgaccugagcguggccuaccccgugcccgaccccagagccguggugggcgccuucgacguguggggccagggcaccauggugaccgugagcagc

SEQ ID NO: 32788 - RNA, 432 nt, Artificial Sequence
  derived and/or modified sequence opt4 from anti-HIV_cap256-048-030261_VR-Chain
caggugcagcugguggagagcggcggcggcguggugcagcccggcggcagccugagacugagcugcgccgccagcggcuucaccuucagcaccuucggcaugcacugggugagacaggcccccggcaagggccuggaguggguggccgugaucagccacgacggcagcaacaaguacuacgccgacagccugaagggcagauucaccaucagcagagagaacagcaagaacacccuguaccugcagaugaacagccugagacuggaggacaccgccguguaccacugcgccaaggaccugggcggcagcaagagcgacgagugggccaccgacuacuacgaccugagcguggccuaccccgugcaggaccccagagccguggugggcguguucgacaucuggggccagggcaccauggugaccgugagcagc

SEQ ID NO: 32789 - RNA, 432 nt, Artificial Sequence
  derived and/or modified sequence opt4 from anti-HIV_cap256-048-029362_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccggcaucagcuucgccggcaccaacaaguacuacgccgacagcgugaagggcagauucaccaucagcagagacaacagcaagaacacccuguaccugcagaugaacagccugagaaccgaggacgccgcccuguacuacugcgccaaggacaugagagaguucgagugcgaggagugggccagcgacuacuacgacuucggcagagacuaccccugccaggaccccagaggcguggugggcaucuucgacaucuggggccagggcaccauggugaccgugagcagc

SEQ ID NO: 32790 - RNA, 432 nt, Artificial Sequence
  derived and/or modified sequence opt4 from anti-HIV_cap256-048-027638_VR-Chain
caggugcagcugguggagagcggcggcggcguggugcagcccggcagaagccugagacugagcugcguggccagcggcuucaucuucagcagcuacggcauccacugggugagacaggcccccggcaagggccuggaguggguggccgugaucagcggcgacggcaccaacaaguacugcgccgacagcgugaagggcagauucaccaucagcagagacaacagcaagaacaccguguuccugcagaugaacagccugagagccgaggacaccgccguguucuacugcgccaaggaccugggcgagagcgacaaggaggaguggcccagcgacuacuacgacuucggcagagacuucaccggccaggugcccagagccguggugggcgccuucgacaucuggggccagggcaccauggugaccgugagcagc

SEQ ID NO: 32791 - RNA, 432 nt, Artificial Sequence
  derived and/or modified sequence opt4 from anti-HIV_cap256-048-027613_VR-Chain
gugcagcagcugguggagagcggcggcgacguggugcagcccggcaccagccugagacugagcugcgaggccagcggccugauccugagcggcuacggccugcacugggugagacaggcccccggcaagggcauggaguggguggccgugaucagcuacgacggcagcaacaaguacuacgccgacagcgugaagggcagauucaccaucagcagagacaacagcaagaacaccguguaccugcagaugaacagccugagaggcguggacaccgccguguacuacugcgccaaggaccugggcggcggcgagguggaggagugggccaccgacuacuacgacuggagcaccgccuaccccguggagcaccccagagccguggugggcguguucgacaucuggggccagggcaccaaggugaccgugagcagc

SEQ ID NO: 32792 - RNA, 432 nt, Artificial Sequence
  derived and/or modified sequence opt4 from anti-HIV_cap256-048-026627_VR-Chain
caggugcagcugcugggcagcggcggcggcagcgugcagcccggcggcagccugagacugaccugcgccgugagcggcuucaccuucagcagcuucgccaugagcugggugagacaggcccccggcaagggccuggaguggguggccuucaucagcagcgacggcaccaacaagaacuacggcgacagcgugaagggcagauucaccaucagcagagacaacagcaagaacacccuguuccugcagaugaacagccugagagccgaggacaccgcccuguacuacugcgccaaggaccugggcggcuacaagagcgacgagugggccaccgacuacuacgaccugagcaucgccuaccccauccaggaccccagagccguggugggcgccuucgacaucuggggccagggcaccauggugaccgugagcagc

SEQ ID NO: 32793 - RNA, 432 nt, Artificial Sequence
  derived and/or modified sequence opt4 from anti-HIV_cap256-048-026239_VR-Chain
cagaugcagcugguggagagcggcggcggcguggugcagcccggcagaagccugagacugagcugcgccgccagcggcuucaccuucaacagcuacgccaugcacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagaaccgaggacgccgcccuguacuacugcgccaaggacaugagagaguucgagugcgaggagugggccagcgacuacuacgacuucggcagagacuaccccugccaggaccccagaggcguggugggcaucuucgacaucuggggccagggcaccauggugaccgugagcagc

SEQ ID NO: 32794 - RNA, 432 nt, Artificial Sequence
  derived and/or modified sequence opt4 from anti-HIV_cap256-048-025518_VR-Chain
caggugcagcugguggagagcggcggcggcguggugcagcccggcagaagccugagacugagcugcgccgugagcggcuucaccuucagccagcacgccaugcacugggugagacaggcccccggcaagggccuggagugggugacccugaucagcaacgacggcaccgagaaguucuacgccgacagcgugaagggcagauucaccaucagcagagacaacagcaagaacacccuguaccugcagaugaacagccugagcguggaggacaccgccguguacuacugcgccaaggaccugggcaagaacaaggacgacgagugggccaccgacuacuacgacaucagcaucgccuaccccgugcccgaccccagagccguggugggcguguucgacaucuggggccagggcaccguggugaccgugagcagc

SEQ ID NO: 32795 - RNA, 432 nt, Artificial Sequence
  derived and/or modified sequence opt4 from anti-HIV_cap256-048-024854_VR-Chain
caggugcagcugguggagagcggcggcggcguggugcagcccggcagaagccugacccugagcugcgccgccagcggcuucaccuucaacaacuacgacaugcacugggugagacaggcccccggcaagggccuggaguggguggccuucaccagauacgacggcagcaaccaguacuacgccgacagcgugaccggcagauucaccaucagcagagacaacagcaagaacaccguguaccugcagaugaacagccugagaggcguggacaccgccguguacuacugcgccaaggaccugggcggcggcgagguggaggagugggccaccgacuacuacgacuggagcaucgccuaccccguggagcaccccagagccguggugggcguguucgacaucuggggccagggcaccaaggugaccgugagcagc

SEQ ID NO: 32796 - RNA, 432 nt, Artificial Sequence
  derived and/or modified sequence opt4 from anti-HIV_cap256-048-024537_VR-Chain
caggugcagcugguggagagcggcggcgccguggugcagcccggcagaagccugagacugagcugcguggccagcggcuucaccuucagcagcuacgccaugcacugggugagacaggcccccggcaagggccuggacuggguggcccugaucagcuacgacggcagcaacaaguacuucgccgacagcgugaagggcagauucgccaucagcagagacaacagcaagaacacccuguaccugcagaugaacagccugagacccgaggacaccgccguguacuacugcgccaaggaccugggcggcggcgagugcgagaccugggccagcgacuacuacgacuucggcaaggacuaccccugccuggaccccagagacguggugggcaccuucgacaucugggugcagggcacccuggugaccgugagcagc

SEQ ID NO: 32797 - RNA, 432 nt, Artificial Sequence
  derived and/or modified sequence opt4 from anti-HIV_cap256-048-021781_VR-Chain
caggugcaccugguggagagcggcggcggccuggugaagcccggcggcagccugagacugagcugcgaggccagcggcuucagcuucagcaacuacgccauggacugggugagacaggcccccggcaagggccuggaguggguggccuucgugagcagcgacggcagcaacaagaacuacgccgacagcgugaagggcagauucaccaucagcagagacaacagcaagaacaccguguaccugcagaugaacagccugagaguggaggacaccgccguguacuacugcgccaaggaccugggcgccaacaaggacgacgagugggccaccgacuacuacgaccugagcguggccuaccccgugcccgaccccagagccguggugggcgccuucgacguguggggccagggcaccauggugaccgugagcagc

SEQ ID NO: 32798 - RNA, 432 nt, Artificial Sequence
  derived and/or modified sequence opt4 from anti-HIV_cap256-048-021758_VR-Chain
caggugcagcugguggagagcggcggcggcguggugcagcccggcagaagccugagacugagcugcgccgccagcggcuucaccuucagcagauacggcaugcacugggugagacaggcccccggcaagggccuggaguggguggccgugaucagcuacgacggcagcaaggaguacuacgccgacagcgugaagggcagauucaccaucagcagagacaacagcaaggacacccuguaccugcagaugagcagccugagaguggaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32799 - RNA, 432 nt, Artificial Sequence
  derived and/or modified sequence opt4 from anti-HIV_cap256-048-020988_VR-Chain
caggugcagcugguggagagcggcggcggcguggugcagcccggcagaagccugagacugagcugcgaggccagcgccuucaccuucagcagcuacggcaugcacugggugagacaggcccccggcaagggccuggagugggugaccuucaucagcuacagcggcaacaacaaguacuacgccgacagcgugaagggcagauucaccgugagcagagacaacagcaagaacacccuguaccugcagaugaacagccugaccagcgaggacaccgccguguacuacugcgccaaggaccugggcggcagcaagaccgacgaguggggcaccgacuacuacgaguucuggaacgccuaccccgugcaggaccccagagugguggugggcgccuucgacaucuggggccacggcaccauggugaccgugagcagc

SEQ ID NO: 32800 - RNA, 435 nt, Artificial Sequence
  derived and/or modified sequence opt4 from anti-HIV_cap256-048-020663_VR-Chain
caggugcagcugguggagagcggcggcggcguggugcagcccggcaugagccugagacugagcugcgccgccagcggcuucaccuucagcaacuucggcaugcacugggugagacaggcccccggcaagggccuggaguggguggccgugaucagccacgacggcaacaacaaguacuaccccgacagcgugcagggcagauucaccaucagcagagagaacagcaagaacacccuguaccugcagaugaacagccugaagcccgaggacaccgccguguacuucugcgccaaggaccugggcggcgagagcgagguggaggagugggccagcgacuacuacgacuucggcagagacauccccggccccgaccccagaggcguggugggcacccuggacaucuggggccacggcaccauggugaccgugagcagc

SEQ ID NO: 32801 - RNA, 432 nt, Artificial Sequence
  derived and/or modified sequence opt4 from anti-HIV_cap256-048-020590_VR-Chain
caggugcagcugguggagagcggcggcggcguggugcagcccggcggcgugcccagacuggccugcgccgccagcggcuucaccuucagcagcuacgccaugcacugggugagacaggcccccggcaagggccuggagugggugaccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcggcaccaaggacgacgagugggccaccgacuacuacgacaucagcaucgccuaccccgugcaggaccccagagccguggccggcgccuucgacaucuggggccagggcaccauggugaccgugagcagc

SEQ ID NO: 32802 - RNA, 432 nt, Artificial Sequence
  derived and/or modified sequence opt4 from anti-HIV_cap256-048-019765_VR-Chain
caggugcagcugguggagagcggcggcggcguggugcagcccggcagaagccugagacugagcugcgccgccagcggcuucaucuucaccaacuacgccauggacugggugagacaggcccccggcaagggccuggaguggguggccgugaucagcagcgacggcagcaacaagaacuacgccgacagcgugaagggcagauucaccaucagcagagacaacagcaagaacaccgugagccugcagaugaacagccugagagccgaggacaccgccguguacuacugcgccaaggaccugggcgacagcaagaaggacgagugggccaccgacuacuacgaccugagcaucgccuaccccgugcccgaccccagagccguggugggcgccuucgacaucuggggccagggcaccauggugaccgugagcagc

SEQ ID NO: 32803 - RNA, 432 nt, Artificial Sequence
  derived and/or modified sequence opt4 from anti-HIV_cap256-048-019254_VR-Chain
caggugcagcugguggagagcggcggcggcguggugcagcccggcagaagccugagacugagcugcgccgccagcggcuucaccagcagcaccuacgccaugcacugggugagacaggcccccggcaagggccuggaguggguggcccugaucagcuacgacggcaccgacaaguacuacgccgacagcgugaagggcagauucaccaucagcagagacaacagcaagaacacccuguaccugcagaugaacagccugagaguggaggacaccgccguguaccacugcgccaaggaccugggcggcaacaagcccgacgagugggccaccgacuacuacgaccugagcaucgccuaccccgugcaggaccccagagccguggugggcguguucgacaucuggggccagggcaccaucaucaccgugagcagc

SEQ ID NO: 32804 - RNA, 432 nt, Artificial Sequence
  derived and/or modified sequence opt4 from anti-HIV_cap256-048-018073_VR-Chain
caggugcagcugguggagagcggcggcggcguggugcagcccggcagaagccugagacugagcugcgccgccagcggcuucagccugagcagcuacgccauggacugggugagacaggcccccggcaagggccuggaguggguggccgugaucagcagcgacggcaccaacaaguacuacgccgacagcgugaagggcagauucaccaucaccagagacaacagcaagaacacccuguaccugcagaugaacagccugagaguggaggacaccgcccuguacuacugcgccaaggacaugggcgagagcgagaaggaggagugggccagcgacuacuacgacuucggcagagacauccccggccaggaccccagaggcgaggugggcagcuucgacaucuggggccagggcaccauggugaccgugagcagc

SEQ ID NO: 32805 - RNA, 432 nt, Artificial Sequence
  derived and/or modified sequence opt4 from anti-HIV_cap256-048-016775_VR-Chain
gaggugcagcugguggaguucggcggcggccuggugcagcccggcagaagccugagacugagcugcgccgccagcgccuucaccuucagccacuacggcauccacugggugagacaggcccccggcaagggccuggaguggguggccgugaucagccacgacggcagcaccaaggacuacgccgacagcgugaagggcagauucaccaucagcagagacaacagcaagaacaccauguaccugcagaugaacagccugagagccgaggacaccgccguguacuacugcgccagagaccugggcgagagcgagaccgaggagugggccaccgacuacuacgacuucagcaucgccuaccccgugcagaaccccagaggcgugaucggcgugcuggacaucuggggccugggcaccauggugaccgugagcagc

SEQ ID NO: 32806 - RNA, 432 nt, Artificial Sequence
  derived and/or modified sequence opt4 from anti-HIV_cap256-048-016069_VR-Chain
caggugcagcugguggagagcggcggcggcguggugcagcccggcagaagccugagacugagcugcgccgccagcggcuucaccuucagcaaguacgccaugcacugggugagacaggcccccggcaagggccuggaguggguggccuucguggccuucgacgagagcgccaaguucuacgccgacagcgugaagggcagauucaccaucagcagagacaacagcaagaacacccugagccugcagaugaacagccugagagccgaggacaccgccguguacuacugcgccaaggaggugggcgagaacaaggacgacgagugggccagcgacuacuacgaccugagcaucgccuaccccgugcacgaccccagagccguggugggcggcuucgacguguggggccagggcaccauggugaccgugagcagc

SEQ ID NO: 32807 - RNA, 432 nt, Artificial Sequence
  derived and/or modified sequence opt4 from anti-HIV_cap256-048-015867_VR-Chain
caggugcagcugguggagagcggcggcggcguggugcagcccggcagaagccugagacugagcugcagcgccagcggcuucagcuucaccaacuacgccauggacugggugagacaggcccccggcaagggccuggaguggguggccgugaucagcagcgacggcagcaacaagaacuacgccgacagcgugaagggcagauucaccaucagcagagacaacagcaagaacacccuguuccugcagaugaacagccugagacccgaggacaccgccguguacuucugcgccaaggaccugggcgccaacaaggacgacgagugggccaccgacuacuacgaccugagcaucgccuaccccgugcacgaccccagagccguggugggcaucuucgaccuguggggccagggcaccauggugaccgugagcagc

SEQ ID NO: 32808 - RNA, 432 nt, Artificial Sequence
  derived and/or modified sequence opt4 from anti-HIV_cap256-048-015673_VR-Chain
caggugcaccugguggagagcggcggcggcguggugcagcccggcagaagccugagacugagcugcgccgccagcggcuucaccuucagcaacuucgccaugggcugggugagacaggcccccggcaagggccuggaguggguggccuucaucagcagcgacggcaccaacaagaacuacggcgacagcgugaagggcagauucaccaucagcagagacaacagcaagaacacccuguuccugcagaugaacagccugagagccgaggacaccgcccuguacuacugcgccaaggaccugggcggcuacaagagcgacgagugggccaccgacuacuacgaccugagcaucgccuaccccauccaggaccccagagccguggugggcgccuucgacaucuggggccagggcaccauggugaccgugagcagc

SEQ ID NO: 32809 - RNA, 432 nt, Artificial Sequence
  derived and/or modified sequence opt4 from anti-HIV_cap256-048-015156_VR-Chain
caggugcagcugguggagagcggcggcggcguggugcagcccggcagaagccugagacugagcugcgccgccagcggcuucaccuucagcguguacgcccugcacugggugagacagacccccggcaagggccuggaguggguggcccugaucagcuacgacggcaccaacaaguacuacguggacagcgugaagggcagauucaccaucagcagagacaacagcaagaacacccuguaccugcagaugaacagccugaccgccgaggacaccgccguguacuacugcgccaaggaccugggcggcagcaagaacgacgagugggccaccgacuacuacgaccugagcaucgccuaccccauccaggaccccagagccguggccggcaucuucgacguguggggcagaggcaccauggugaccgugagcagc

SEQ ID NO: 32810 - RNA, 432 nt, Artificial Sequence
  derived and/or modified sequence opt4 from anti-HIV_cap256-048-014521_VR-Chain
gaggugcagcugguggagagcggcggcggccuggugcagcccggcagaagccugagacugagcugcgccgccagcggcuucaucuucagcagcuacggcauccacugggugagacagggccccggcaagggccuggaguggguggcccugaucagcggcgacggcaacaacaaguacuacgccgacagcgugcagggcagauucagcaucagcagagacaacagcaagaacacccuguaccugcagaugaacagccugagagccgaggacaccgccguguacuacugcgccaaggaccugggcgagagcgacaaggaggaguggcccagcgacuacuacgacuucggcagagacuucaccggccaggaccccagagccguggugggcguguucgacaucuggggccagggcaccaccgugaucgugagcagc

SEQ ID NO: 32811 - RNA, 432 nt, Artificial Sequence
  derived and/or modified sequence opt4 from anti-HIV_cap256-048-014475_VR-Chain
caggugcagcugguggagagcggcggcggcguggugcagcccggcagaagccugagacugagcugcgccgccagcggcuucaccuucaacaccuucggcaugcacugggugagacaggcccccggcaagggccuggaguggguggccgugaucagccacgacggcaacaacaaguacuacgccgacagccugaagggcagauucaccaucagcagagagaacagcaagaacacccuguuccugcagaugaacagccugagagccgaggacaccagcguguacuacugcgccaaggaccugggccacggcgagugcgaggagugggccagcgacuacuacgacuucggcaaggacuaccccugccugacccccagaggcguggccggcaccuucgacaucuggggccacggcaccaccgugaccgugagcagc

SEQ ID NO: 32812 - RNA, 432 nt, Artificial Sequence
  derived and/or modified sequence opt4 from anti-HIV_cap256-048-013798_VR-Chain
caggugcagcugguggagagcggcggcggcguggugcagcccggcagaagccugagacugagcugcgccgccagcggcuucaccuucaacaacuacggcacccacugggugagacaggcccccggcaagggccuggaguggguggccgugaucagcgacagcggcagcaacaaguacuacgccgacagcgugaagggcagauucaccaucagcagagacaacagcaagaacacccuguaccugcagaugaacagccugagagccgaggacaccgccguguacuucugcgccaaggaccugggcggcagagagaccgaggagugggccagcgacuacuacgacuucggcagagacuuccccggccaggaccagagagccguggccggcguguucgacauguggggccagggcaccauggugaccgugagcagc

SEQ ID NO: 32813 - RNA, 432 nt, Artificial Sequence
  derived and/or modified sequence opt4 from anti-HIV_cap256-048-013271_VR-Chain
gaggugcagcugguggagagcggcggcggcguggugagacccggcggcagccugagacugagcugcgccgccagcggcuucaucuucagcagcuacggcauccacugggugagacaggcccccggcaagggccuggaguggguggccgugaucagcggcgacggcaccaacaaguacugcgccgacagcgugaagggcagauucaccaucagcagagacaacagcaagaacacccuguaccugcagaucaacagccugagaguggaggacaccgccguguacuacugcgccaaggaccugggcaagaacaaggacgacgagugggccaccgacuacuacgaccugagcaucgccuaccccgugcccgaccccagagccguggugggcguguucgacaucuggggccagggcaccguggugaccgugagcagc

SEQ ID NO: 32814 - RNA, 432 nt, Artificial Sequence
  derived and/or modified sequence opt4 from anti-HIV_cap256-048-013180_VR-Chain
caggugcagcugguggagagcggcggcggcguggugcagcccggcagaagccugagacugagcugcgccgccagcggcuucaccuucagcaagaacggcaugcacugggugagacaggcccccggcaagggccuggaguggguggccuucguggccuucgacggcagcgacaaguacuacgccgacagcgugaagggcagauucgugaucagcagagacaacagcaagaacacccugagccugcagaugaacagccugagagccgaggacaccgccguguacuacugcgccaaggaggugggcgaggacaaggacgacgagugggccagcgacuacuacgaccugagcaucgccuaccccgugcacgaccccagagccguggugggcggcuucgacaucuggggccagggcaccauggugaccgugagcagc

SEQ ID NO: 32815 - RNA, 432 nt, Artificial Sequence
  derived and/or modified sequence opt4 from anti-HIV_cap256-048-012148_VR-Chain
caggugcagcugguggagagcggcggcggcguggugcagcccggcagaagccugagacugagcugcgccgccagcggcuucaccuucacccacuacgccauggacugggugagacaggcccccggcaagggccuggaguggguggccgugaucagcagcgacggcagcagcaagaacuacgccgacagcgugagaggcagauucaccaucagcagagacaacagcaagaacacccugagccugcugaugaacggccugagacccgaggacaccgccguguacuacugcgccaaggacgugggcgacgugaagaacgacgagugggccaccgacuacuacgaccugagcaucgccuaccccgugcaggaccccagagccguggugggcgccuucgacuucuggggccagggcaccauggugaccgugagcgcc

SEQ ID NO: 32816 - RNA, 432 nt, Artificial Sequence
  derived and/or modified sequence opt4 from anti-HIV_cap256-048-011870_VR-Chain
caggugcagcugguggagagcggcggcggcguggugcagcccggcagaagccugagacugagcugcgccgugagcggcuucaccuucagcuucuacggcaugcacugggugagacaggcccccggcaagggccuggaguggguggccgugaucagcuacgacggcaacaacaaguacuacguggacagcgugaagggcagauucaucaucagcagagacaacagcaagaacacccuguaccugcagaugaacagccugagaguggaggacaccgccguguacuacugcgccagagaccugggcgagagagagaacgaggagugggccaccgacuacuacgacuucagcaucgccuaccccaucgagggccccagaggcguggugggcguguucgacaucuggggcagaggcaccauggugaccgugagcagc

SEQ ID NO: 32817 - RNA, 432 nt, Artificial Sequence
  derived and/or modified sequence opt4 from anti-HIV_cap256-048-011530_VR-Chain
caggugcaccugguggagagcggcggcggcguggugcagcccggcagaagccugagacugagcugcgccgccagcggcuucagcuucagaaacuacgccauggacugggugagacaggcccccggcaagggccuggaguggguggccgugaucagcagcgacggcagcgacaagcacuacgccgacagcgugagaggcagauucaccaucagcagagacaacagcaagaacacccuguaccugcagaugaacagccugagaguggaggacaccgccguguacuacugcgccaaggaccugggcgccaacaagaacgacgagugggccaccgacuacuacgacuucagcaucgccuaccccgugcccgaccccagagccguggugggcgccuucgacaucuggggccagggcaccauggugaccgugagcagc

SEQ ID NO: 32818 - RNA, 432 nt, Artificial Sequence
  derived and/or modified sequence opt4 from anti-HIV_cap256-048-010968_VR-Chain
caggugcagcugguggagagcggcggcggcguggugcagcccggcagaagccugagacugagcugcgccgccagcggcuucaucuucagcagcuacggcaugcacugggugagacaggcccccggcaagggccuggaguggguggcccugaucagcggcgacggcagcaacaaguacuacgccgacagcgugaagggcagauucaccaucagcagagacaacagcaagaacacccuguaccugcagaugaacagccugagagccgaggacagcgcccuguacuucugcgccaaggaccugggcgagagcgacaaggaggaguggcccagcgacuacuacgacuucggcagagacuucaccggccaggugcccagagccguggugggcaucuucgacauguggggccagggcaccauggugaccgugagcagc

SEQ ID NO: 32819 - RNA, 426 nt, Artificial Sequence
  derived and/or modified sequence opt4 from anti-HIV_cap256-048-010224_VR-Chain
gaggugcaccugguggagagcggcggcgaccuggugcagcccggcggcagccugagacugagcugcguggugagcgaguucaccuucagcagcuacggcaugcacugggugagacaggcccccggcaagggccuggaguggguggccuucaucagauacgacggcagcaacaaguacuacgccgacagcgugaagggcagauucaccaucagcagagacaacagcaagguguaccuggagaugaacagccugagagccgaggacaccgccguguacuacugcgccaaggaggugggcgagaacaaggacgacgagugggccagcgacuacuacgaccugagcaucgccuaccccauccacgaccccagagccguggugggcggcuucgacaucuggggccagggcaccauggugaccgugagcagc

SEQ ID NO: 32820 - RNA, 432 nt, Artificial Sequence
  derived and/or modified sequence opt4 from anti-HIV_cap256-048-009749_VR-Chain
caggugcagcugguggagagcggcggcggcguggugcagcccggcagaagccugagacugagcugcggcgccagcggcuucaccuucagcagcuacgccaugcacugggugagacaggcccccggcagaggccuggaguggguggccuucaccagcagcgacggcagcaacaagaacuacggcgacagcgugaagggcagauucaccaucagcagagacaacagcaagaacacccuguuccugcagaugaacagccugagagccgaggacaccgcccuguacuacugcgccaaggacgugggcgaguacaagagcgacgagugggccaccgacuacuacgaccugagcaucgccuaccccauccaggaccccagagccauggugggcgccuucgacaucuggggccagggcaccauggugaccgugagcagc

SEQ ID NO: 32821 - RNA, 432 nt, Artificial Sequence
  derived and/or modified sequence opt4 from anti-HIV_cap256-048-009623_VR-Chain
caggugcagcugguggagagcggcggcggcguggugcagcccggcagaagccugagacugagcugcgccgccagcggcuucagcuucagcaaguacggcaugcacugggugagacaggcccccggcaagggccuggaguggguggccuucguggccuucgacgagggcgacaaguacuacguggacagcgugaagggcagauucaccaucagcagagacaacagcaagaacacccugagccugcagaugaacagccugagagccgaggacaccgccguguacuacugcgccaaggaggugggcgagaacaaggacgacgagugggccagcgacuacuacgaccugagcaucgccuaccccauccacgaccccagagccguggugggcggcuucgacaucuggggccagggcaccauggugaccgugagcagc

SEQ ID NO: 32822 - RNA, 432 nt, Artificial Sequence
  derived and/or modified sequence opt4 from anti-HIV_cap256-048-008234_VR-Chain
caggugcagcugguggagagcggcggcggcguggugcagcccggcagaagccugagacugagcugcgccgccagcggcuucaccuucaccaacuacgccauggacugggugagacaggcccccggcaagggccuggaguggguggccgugaucagcagcgacggcagcaacaagaacuacgccgacagcgugaagggcagauucaccaucagcagagacaacagcaagaacaccguguaccugcagaugagcagccugagacccgaggacaccgccguguacuacugcgccaaggacgugggcgacaccaagagcgacgagugggccaccgacuacuacgaccugagcaucgccuaccccgugcaggaccccagagccguggugggcgccuucgacaucuggggccagggcaccauggugaccgugagcagc

SEQ ID NO: 32823 - RNA, 432 nt, Artificial Sequence
  derived and/or modified sequence opt4 from anti-HIV_cap256-048-008149_VR-Chain
caggugcagcugguggagagcggcggcggcguggugcagcccggcagaagccugagacugagcugcgccgccagcggcuucaccuucagcguguacaccaugcacugggugagacaggcccccggcaagggccuggaguggguggccgugaucagcuacgacggcagaaacaaguacuacgccgacagcgugaagggcagauucaccaucagcagagacaacagcaagaacaccguguaccugcagaugaacagccugagaguggaggacaccgccguguacuacugcgccaaggaccugggcgccaacaaggacgacgagugggccaccgacuacuacgaccugagcguggccuaccccgugcccgaccccagagccguggugggcgccuucgacguguggggccagggcaccauggugaccgugagcagc

SEQ ID NO: 32824 - RNA, 432 nt, Artificial Sequence
  derived and/or modified sequence opt4 from anti-HIV_cap256-048-007301_VR-Chain
caggugcagcugguggagagcggcggcggcguggugcagcccggcagaagccugagacugagcugcgccgccagcggcuucagcuucaacuacuacgccauggacugggugagacaggcccccggcaagggccuggaguggguggccgugaucagcagcgacggcagaaacaagaacuacgccgacagcgugaagggcagauucaccaucagcagagacaacagcaagaacacccuguaccugcagaugaacagccugagcguggaggacaccgccguguacuacugcgccaaggaccugggcaagaacaaggacgacgagugggccaccgacuacuacgacaucagcaucgccuaccccgugcccgaccccagagccguggugggcguguucgacaucuggggccagggcaccguggugaccgugagcagc

SEQ ID NO: 32825 - RNA, 432 nt, Artificial Sequence
  derived and/or modified sequence opt4 from anti-HIV_cap256-048-007174_VR-Chain
caggugcagcugguggagagcggcggcggcguggugcagcccggcagaagccugagacugagcugcgccgccagcggcuucaccuucaacagcuacggcauggccugggugagacaggcccccggcaagggccuggaguggguggcccugaucagcuacgacggcagcaacaaguacuacgccgacagcgugagaggcagauucaccaucagcagagacaacagcaaggacacccuguaccugcagauggacggccugagacccgaggacaccgcccuguacuacugcgccaaggaccugggcgagagcgagugcgaggagugggccagcgacuacuacgacuucggcagagacuaccccugccuggcccccagaggcgugcccggcaccuucgacaucuggggccagggcaccauggugaccgugagcagc

SEQ ID NO: 32826 - RNA, 432 nt, Artificial Sequence
  derived and/or modified sequence opt4 from anti-HIV_cap256-048-007079_VR-Chain
caggugcagcuggccgagagcggcggcggcguggugcagcccggcagaagccugagacugagcugcgccgccagcggcuucaccuucagcaucuacggcaugcacugggugagacaggcccccggcaagggccuggaguggguggccuucauccugagcgacggcaccgacaaguacagcgccgacagcgugaagggcagauucaccaucagcagagacaacagcaagaacacccuguaccugcagaugaacagccugagagccgaggacaccgccguguacuacugcgccaaggaccugggcaaggccaaggacgacgagugggccaccgacuacuacgacuucagcaucgccuaccccgugcacgaccccagaggcguggccggcaucuucgacaucuggggccagggcaccauggugaccgugagcagc

SEQ ID NO: 32827 - RNA, 432 nt, Artificial Sequence
  derived and/or modified sequence opt4 from anti-HIV_cap256-048-007033_VR-Chain
caggugcagcugguggagagcggcggcggcguggugcagcccggcagaagccugagacugagcugcgccgccagcggcuucaccuucagcaacuucggcuuccacugggugagacaggcccccggcaagggccuggaguggguggccgccaucagcuucgccggcaacaacaaguacuacgccgacagcgugaagggcagauucaccaucagcagagagaacagcaagaacauccuguaccugcagaugaacagccugagaggcgaggacaccgccguguacuacugcgccaaggaccugagagaguucgagugcgaggagugggccagcgacuacuacgacuucggcagagacuaccccugccaggaccccagaggcguggugggcaccuucgacguguggggccacggcagccuggugaccgugagcagc

SEQ ID NO: 32828 - RNA, 432 nt, Artificial Sequence
  derived and/or modified sequence opt4 from anti-HIV_cap256-048-006128_VR-Chain
caggugcagcugguggagagcggcggcggcguggugcagcccggcagaagccugagacugagcugcgccgccagcggcuucaccuucagcaccuacgccaugcacugggugagacaggcccccggcaagggccuggaguggguggcccugaucagcuacgacggcaccgacaaguacuacgccgacagcgugaagggcagauucaccaucagcagagacaacagcaagaacacccuguaccugcagaugaacagccugagaguggaggacaccgccguguaccacugcgccaaggaccugggcggcagcaagagcgacgagugggccaccgacuacuacgacuggagcaucgccuaccccgugcacgaccccagagccguggugggcguguucgacaucuggggccagggcacccuggugaccgugagcagc

SEQ ID NO: 32829 - RNA, 432 nt, Artificial Sequence
  derived and/or modified sequence opt4 from anti-HIV_cap256-048-005999_VR-Chain
caggugcagcugguggagagcggcggcggcguggugcagcccggcagaagccugagacugagcugcgccgccagcggcuucaccuucacccacuucgccauggacugggugagacaggcccccggcaagggccuggaguggguggccgugaucagcagcgacggcagcagcaagaacuacgccgacagcgugaagggcagauucaccaucagcagagacaacagcaagaacaccgugagccugcagaugaacagccugagacccgaggacaccgccguguacuacugcgccaaggaccugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32830 - RNA, 432 nt, Artificial Sequence
  derived and/or modified sequence opt4 from anti-HIV_cap256-048-005394_VR-Chain
caggugcagcugguggagagcggcggcggcguggugcagcccggcagaagccugagacugagcugcgccgccagccaguucaccuucagcagcuacggcaugcacugggugagacaggcccccggcaagggccuggaguggguggccgccaucagcuucgccggcaccaacaaguacuacgccgacagcgugaagggcagauucaccaucagcagagacaacagcaagaacgcccuguaccugcagaugaacagccugagagccgaggacaccgcccuguacuacugcgccaaggaccugagagaguucgagugcgaggagugggccagcgacuacuacgacuucggcagagacuaccccugccaggaccccagaggcguggugggcaccuucgacaucuggggccagggcaccauggugaccgugagcagc

SEQ ID NO: 32831 - RNA, 432 nt, Artificial Sequence
  derived and/or modified sequence opt4 from anti-HIV_cap256-048-004226_VR-Chain
caggugcagcugguggagagcggcggcggcguggugcagcccggcagaagccugagacugagcugcgccgccagcggcuucaccuucaacaagcacggcaugcacugggugagacaggcccccggcaagggccuggaguggguggccuucguggccuucgacggcagcgacaaguacuacgccgacagcgugaagggcagauucaccaucagcagagacaacagcaagaacacccugagccugcagaugaacaaccugagagccgaggacaccgccguguacuacugcgccaaggaggugggcgacaacaaggacgacgagugggccagcgacuacuacgaccugagcaucgccuaccccgugcaggaccccagagccguggugggcggcuacgacaucuggggccagggcaccauggugaccgugagcagc

SEQ ID NO: 32832 - RNA, 432 nt, Artificial Sequence
  derived and/or modified sequence opt4 from anti-HIV_cap256-048-004097_VR-Chain
caggugcagcugguggagagcggcggcggcguggugcagcccggcagaagccugagacugagcugcgccgccagcggcuucaccuucagcgccuacaccgugcacugggugagacaggcccccggcagaggccuggagugggugagcgugaucagcuacgacgacagaaacaaguacuacgcccacagcgugaagggcagauucaccaucagcagagacaacagcaagaacacccuguaccugcagaugaacagccugagaagagaggacaccgccguguacuacugcgccaaggaccugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32833 - RNA, 432 nt, Artificial Sequence
  derived and/or modified sequence opt4 from anti-HIV_cap256-048-003289_VR-Chain
caggugcagcugguggagagcggcggcggcguggugcagcccggcagaagccugagacugagcugcgccgccagcggcuucaccuucagcaaguacggcaugcacugggugagacaggcccccggcaagggccuggaguggguggccuucguggccuucgacggcagcagcaagaacuacgccgacagcgugaagggcagauucaccaucagcagagacaacagcaagaacaccgugagccugcagaugaacagccugagacccgaggacaccgccguguacuacugcgccaaggaccugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32834 - RNA, 432 nt, Artificial Sequence
  derived and/or modified sequence opt4 from anti-HIV_cap256-048-002601_VR-Chain
caggugcagcugguggagagcggcggcggcguggugcagcccggcagaagccugagacugagcugcgccgccagcggcuucagcuucaacaacuacgccauggacugggugagacaggcccccggcaagggccuggaguggguggccgugaucagcagcgacggcagaaacaagaacuacgccgagagcgugaagggcagauucaccaucagcagagacaacagcaagaacaccguguaccugcagaugaacagccugagagccgaggacaccgccguguacuacugcgccaaggacgugggcgacaccaagaaggacgagugggccaccgacuacuacgaccugagcaucgccuaccccgugcaggacccccaggccguggugggcgccuucgacaucuggggccagggcaccauggugaccgugagcagc

SEQ ID NO: 32835 - RNA, 432 nt, Artificial Sequence
  derived and/or modified sequence opt4 from anti-HIV_cap256-048-002129_VR-Chain
caggugcagcugguggagagcggcggcggcguggugcagcccggcagaagccugagacugagcugcgccgccagcggcuucaccuucagcaccuacgccaugcacugggugagacaggcccccggcaagggccuggaguggguggcccugaucagcuacgacggcaccgacaaguacuacgccgacagcgugaagggcagauucaucaucagcagagacaacagcagaagcacccuguaccugcagaugaacagccugagacuggaggacaccgccguguaccacugcgccaaggaccugggcggcagcaagagcgacgagugggccaccgacuacuacgaccugagcguggccuaccccgugcaggaccccagagccguggugggcguguucgacaucuggggccagggcaccauggugaccgugagcagc

SEQ ID NO: 32836 - RNA, 432 nt, Artificial Sequence
  derived and/or modified sequence opt4 from anti-HIV_cap256-048-001875_VR-Chain
caggugcagcugguggagagcggcggcggcguggugcagcccggcggcagccugagacugagcugcgccaccagcggccugaccuucagcaacuacggcaugcacugggugagacaggcccccggcagaggccuggaguggguggccuucaccagauacgacggcaccuacaacuacuacgccgacagcgugaagggcagauucaccaucagcagagacaacagcaagggcacccuguaccugcagauggacggccugagacccgaggacaccgcccuguacuacugcgccaaggaccugggcgagagagagugcgaggagugggccagcgacuacuacgacuucggcagagacuuccccugccaggaccccagaggcguggugggcaccuucgacaucuggggccagggcaccauggugaccgugagcagc

SEQ ID NO: 32837 - RNA, 432 nt, Artificial Sequence
  derived and/or modified sequence opt4 from anti-HIV_cap256-048-001302_VR-Chain
caggugcagcugguggagagcggcggcggcguggugcagcccggcagaagccugagacugagcugcgccgccagcggcuucaccuucagcuacagcggcaugcacugggugagacaggcccccggcaagggcauggaguggguggccgugaucagcuacgacggcagcaacaaguacuacgccgacagcgugaagggcagauucaccaucagcagagacaacagcaagaacaccguguaccugcagaugaacagccugagaggcguggacaccgccguguacuacugcgccaaggaccugggcggcggcgagguggaggagugggccaccgacuacuacgacuggagcaucgccuaccccguggagcaccccagagccguggugggcguguucgacaucuggggccagggcaccaaggugaccgugagcagc

SEQ ID NO: 32838 - RNA, 432 nt, Artificial Sequence
  derived and/or modified sequence opt4 from anti-HIV_cap256-048-001203_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccaucaucagcuacgacggcaccaucaaguacuacgccgacagcgugaagggcagauucaccaucagcagagacaacagcaagaacaccgugagccugcagaugaacagccugagacccgaggacaccgccguguacuacugcgccaaggacgugggcgccaacaaggacgacgagugggccaccgacuacuacgaccugagcaucgccuaccccgugcccgaccccagagccguggugggcgccuucgacaucuggggccagggcaccauggugaccgugagcagc

SEQ ID NO: 32839 - RNA, 432 nt, Artificial Sequence
  derived and/or modified sequence opt4 from anti-HIV_cap256-048-000383_VR-Chain
caggugcagcugguggagagcggcggcggcguggugcagcccggcagaagccugagacugagcugcaccgccagcggcuucaccuucaaccacuacgccauggacugggugagacaggcccccggcaagggccuggaguggguggccgugaucagcagcgacggcagcgacaagaccuacgccgacagcgugaagggcagauucaccaucagcagagacaacagcaagaacaccguguaccugcagaugaacagccugagagccgaggacaccgccguguacuacugcgccaaggacgugggcggcagcaaggacgacgagugggccaccgacuacuacgaccugagcaucgccuaccccgugcccgaccccagagccguggugggcgccuucgacuucuggggccccggcaccauggugaccgugagcagc

SEQ ID NO: 32840 - RNA, 432 nt, Artificial Sequence
  derived and/or modified sequence opt4 from anti-HIV_cap256-038-261791_VR-Chain
caggugcagcugguggaguucggcggcggcguggugcagcccggcggcagccugagacugagcugcgccgccuucggcuucaccaucagcagcuacggcaugcacugggugagacaggcccccggcaagggccugcaguggguggccuucaucagauacgacgagagcagcaaguucuacgccgacagcgugaagggcagauucaccaucagcagagacaacagcgagaacacccuguaccugcagaugaacagccugagagccgaggacaccgccguguacuacugcgccaaggaccugggcgagagcgagaacgaggagugggccaccgacuacuacgacuucagcaucgccuaccccggccaggaccccagaggcguggugggcaucuucgacaucuggggccagggcaccauggugaccgugagcagc

SEQ ID NO: 32841 - RNA, 432 nt, Artificial Sequence
  derived and/or modified sequence opt4 from anti-HIV_cap256-038-241540_VR-Chain
caggugcagcugguggagagcggcggcggcguggugcagcccggcagaagccugagacugagcugcgccgccagcggcuucaccuucagcaacagcgccaugcacugggugagacaggcccccggcaagggccuggaguggguggcccugaucagcuacgugggcggcaacaucuacuacgccgacagcgugaagggcagauucaccgugagcagagacaacagcaagaagacccuguaccugcagaugaacagccugagaguggaggacaccgccguguacuacugcgugaaggacgugggcgagagcgagaacgaggagugggccagcgacuacuacgacuucggcagagacuaccccggccaggacaccagagccguggugggcgccuucgacaucuggggccagggcaccauggugaccgugagcagc

SEQ ID NO: 32842 - RNA, 432 nt, Artificial Sequence
  derived and/or modified sequence opt4 from anti-HIV_cap256-038-235677_VR-Chain
cuggugcagcugguggagagcggcggcggcguggugcagcccggcggcagccugagacugagcugcgccgccagcggcuucagauucagcagcuacggcaugcacugggugagacaggcccccggcaagggccuggaguggguggccuucaucagauacgacggcagcuucaaggacuacgccgacagcgugagaggcagauucaccaucagcagagagaacagcaagaacacccuguaccugcagaugaacagccugagaaccgacgacaccgccguguacuacugcgccaaggaccugggcgagagcgagaccgaggaguggcccagcgacuacuacgacuucggcagagacuaccccggccaggaccccagaggcguggugggcaccuucgacaucuggggccacggcaccauggugaccgugagcagc

SEQ ID NO: 32843 - RNA, 435 nt, Artificial Sequence
  derived and/or modified sequence opt4 from anti-HIV_cap256-038-234314_VR-Chain
gaggugcagcugcuggagagcggcggcggccuggugcagcccggcggcagccugagacugagcugcgccgccagcggcuucaccuucagcagauacgccaugagcugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccguggacaccgccguguacuacugcgccaaggaccugggcgagggcgagaacgaggagugggccaccgacuacuacgacuucagcuacuggcugcccugccccaaguaccacggcgccuggcuggagcugcuguacaucuggggccagggcaccauggugaccgugagcagc

SEQ ID NO: 32844 - RNA, 432 nt, Artificial Sequence
  derived and/or modified sequence opt4 from anti-HIV_cap256-038-234273_VR-Chain
gaggugcagcugguggagagcggcggcggccugauccagcccggcggcagccugagacugagcugcgccgccagcggcuucaccgugagcaccaacuucaugagcugggugagacaggcccccggcaagggccuggaguggguggccgugaucagcuacgacggcaacaacaaguacuacgccgacagcgugaagggcagauucaccaucagcagagagaacagcaagaacacccuguaccugcagaugaacagccugagaaccgacgacaccgccguguacuacugcgccaaggaccugggcgagagcgagaccgaggaguggcccagcgacuacuacgacuucggcagagacuaccccggccaggaccccagaggcguggugggcaccuucgacaucuggggccacggcaccauggugaccgugagcagc

SEQ ID NO: 32845 - RNA, 432 nt, Artificial Sequence
  derived and/or modified sequence opt4 from anti-HIV_cap256-038-223164_VR-Chain
gaggugcagcugguggagagcggcggcggccuggugagacccggcggcagccugagacugagcugcgccgccagcggcuucagccugggcagcuacuggaugaccugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgcccuguacuacugcgccaaggaccugggcgagagcgagaacgaggagugggccagcgacuacuacgacuucggcagagacuaccccggccaggaccccagaggcguggugggcaccuucgacaucuggggccagggcaccauggugaccgugagcagc

SEQ ID NO: 32846 - RNA, 432 nt, Artificial Sequence
  derived and/or modified sequence opt4 from anti-HIV_cap256-038-220289_VR-Chain
gaggugcagcugguggagagcggcggcggccuggugcagcccggcggcagccugagacugagcugcaccgccagcggcuucaccuucagcagcuacgagaugaacugggugagacaggcccccggcaagggccccgaguggguggccgugaucagcuacgacggcaacaacaaguacuacgccgacagcgugaagggcagauucaccaucagcagagagaacagcaagaacacccuguaccugcagaugaacagccugagaaccgacgacaccgccguguacuacugcgccaaggaccugggcgagagcgagaccgaggaguggcccagcgacuacuacgacuucggcagagacuaccccggccaggaccccagaggcguggugggcaccuucgacaucuggggccacggcaccauggugaccgugagcagc

SEQ ID NO: 32847 - RNA, 432 nt, Artificial Sequence
  derived and/or modified sequence opt4 from anti-HIV_cap256-038-220020_VR-Chain
caggugcagcugguggagagcggcggcggcguggugcagcccggcagaagccugagacugagcugcgccgccagcggcuucaccuucagcagaaacgccaugcacugggugagacaggcccccggcaagggccuggaguggguggcccugaucagcuacgacggcagcaacaaguacuacguggacagcgugaagggcagauucaccaucagcagagacaacagcaagaacacccuguaccugcagaugaacagccugagagccgacgacaccgccguguacuacugcgccaaggaccugggcgagagcgagaccgaggaguggggcaccgacuacuacgacuucagcaccggcuaccccgugcaggaccccagaggcguggugggcgccuucgacaucuggggccagggcaccauggugagcgugagcagc

SEQ ID NO: 32848 - RNA, 432 nt, Artificial Sequence
  derived and/or modified sequence opt4 from anti-HIV_cap256-038-216853_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgugaucagcuacgacggcagcaacaaguacuacgccgacagcgugaagggcagauucaccaucagcagagacaacagcaagaacacccuguacgugcagaugaacagccugagagccgaggacaccgccguguacuacugcgccagagaccugggcgagagcgagaccgaggaguggcccagcgacuacuacgacuucggcagagacuaccccggccaggaccccagaggcguggugggcaccuucgacaucuggggccacggcaccauggugaccgugagcagc

SEQ ID NO: 32849 - RNA, 432 nt, Artificial Sequence
  derived and/or modified sequence opt4 from anti-HIV_cap256-038-213466_VR-Chain
gaggugcagcugguggagagcggcggcggccuggugcagcccggcagaagccugagagugagcugcgccgccagcggcuucaccuucgaggacuacgccaugcacugggugagacaggcccccggcaagggccuggaguggguggccgugaucagcgacgacggcaacaacaaguacuacgccgacagcgugaagggcagauucaccaucagcagagacaacagcaagaacacccuguaccugcagaugaacagccugagaguggaggacaccgccguguacuacugcgugaaggacgugggcgagagcgagaacgaggagugggccagcgacuacuacgacuucggcagagacuaccccggccaggacaccagagccguggugggcgccuucgacaucuggggccagggcaccauggugaccgugagcagc

SEQ ID NO: 32850 - RNA, 432 nt, Artificial Sequence
  derived and/or modified sequence opt4 from anti-HIV_cap256-038-213212_VR-Chain
caggugcagcugguggagagcggcggcggcguggugcagcccggcggcagccugagacugagcugcgccgccagcggcuucaucuucagcgacuacggcaugcacugggugagacaggcccccggcaagggccuggaguggguggccagcaucuggcacgacggcagcaagaaguacuacgccgacagcgugaagggcagauucaccaucagcagagagaacagcaagaacacccuguaccugcagaugaacagccugagagccgaggacaccgccguguaccacugcgccaaggaccugggcgagagcgagaucgaggaguggaccagcgacuacuacgacuucggcagagacuaccccggccaggaccccagaggcguguucggcaccuucgacaucuggggccacggcaccauggugaccgugagcagc

SEQ ID NO: 32851 - RNA, 432 nt, Artificial Sequence
  derived and/or modified sequence opt4 from anti-HIV_cap256-038-213120_VR-Chain
caggugcaccugguggagagcggcggcggccuggugaagcccggcggcagccugagacugagcugcgccgccagcggcuucaccuucagcgacuacuacaugaucuggaucagacaggcccccggcaagggccuggaguggguggccgugaucagcagcgacggcagcaacaagaacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacgacuucgccaccggcuaccccgugcaggaccccagagccguggugggcgccuucgacaucuggggccagggcaccauggugaccgugagcccc

SEQ ID NO: 32852 - RNA, 432 nt, Artificial Sequence
  derived and/or modified sequence opt4 from anti-HIV_cap256-038-212592_VR-Chain
cuggugcagcugguggagagcggcggcggcguggugcagcccggcaagagccugagacugagcugcgccgccagcggcuucaccuucagcagcuacgccaugcacuggaucagacaggcccccggcaagggccuggaguggguggccgugaucagcgacgacggcagcaucaagaacuacgccgacagcgugaagggcagauucaccaucagcagagacaccagcaagaagcugauguaccugcagaugaacagccugagcgccaacgacaccgccguguacuacugcgccaaggaccugggcgagagagagaacgaggagugggccagcgacuacuacgacuucggcagagacuaccccggccaggaccccagaggcguggugggcagcaucgacaccuggggccacggcaccauggugaccgugagcagc

SEQ ID NO: 32853 - RNA, 432 nt, Artificial Sequence
  derived and/or modified sequence opt4 from anti-HIV_cap256-038-211790_VR-Chain
gagcugcagcugguggagagcggcggcggccuggugcagcccggcggcagccugagacugagcugcguggugagcggcuucaccgugagcaccaacuacaucagcugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgcccuguacuacugcgccaaggaccugggcgagagcgagaacgaggagugggccagcgacuacuacgacuucggcagagacuaccccggccaggaccccagaggcguggugggcaccuucgacaucuggggccagggcaccauggugaccgugagcagc

SEQ ID NO: 32854 - RNA, 432 nt, Artificial Sequence
  derived and/or modified sequence opt4 from anti-HIV_cap256-038-209916_VR-Chain
caggugcagcugguggagagcggcggcggcguggugcagcccggcggcagccugagacugagcugcgccgccagcggcuucaccuucagcagcuucggcaugcacugggugagacaggcccccggcaagggccuggagugggugagcuucaucagaaacgacggcggcaucagauacagcgccgacagcgugagaggcagauucaccaucagcagagacaacagcaagaacacccuguaccugcagaugaacagccugagaaccgacgacaccgccguguacuacugcgccaaggaccugggcgagagcgagaccgaggaguggcccagcgacuacuacgacuucggcagagacuaccccggccaggaccccagaggcguggugggcaccuucgacaucuggggccacggcaccauggugaccgugagcagc

SEQ ID NO: 32855 - RNA, 432 nt, Artificial Sequence
  derived and/or modified sequence opt4 from anti-HIV_cap256-038-207938_VR-Chain
caggugcagcugguggagagcggcggcggcguggugcaccccggcagaagccugagacugagcugcgccgccagcggcuucaccuucagcagcuacggcaugcacugggugagacaggcccccggcaagggccuggaguggguggccgugaucagccacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagagacuaccccggccaggaccccagaggcguggugggcguguucgacaucuggggccagggcaccauggugaccgugagcagc

SEQ ID NO: 32856 - RNA, 432 nt, Artificial Sequence
  derived and/or modified sequence opt4 from anti-HIV_cap256-038-202245_VR-Chain
caggugcaccugguggagagcggcggcggcguggugcagcccggcagaagccugagacugagcugcaccgugagcggcuucaccuucggcagcuacgcccugcacugggugagacaggcccccggcaagggccuggaguggcugagcgugaucagcuacgacggcaacaacaaguacuacgccgacagcgugaagggcagauucaccaucagcagagagaacagcaagaacacccuguaccugcagaugaacagccugagagccgaggacaccgccguguaccacugcgccaaggaccugggcgagagcgagaaggaggagugggccagcgacuacuacgacuucggcagagacuaccccggccaggaccccagaggcguggugggcaccuucgacaucuggggccacggcaccauggugaccgugagcagc

SEQ ID NO: 32857 - RNA, 432 nt, Artificial Sequence
  derived and/or modified sequence opt4 from anti-HIV_cap256-038-197721_VR-Chain
caggugcagcugguggagagcggcggcggcguggugcagcccggcaagagccugagacugagcugcgccggcagcggcuucaucuucagcaacuaccccaugcacugggugagacaggcccccggcaagggccuggaguggauggccgacgugagcuacgacggcagcaacaaggacuacgccgacagcgugaagggcagauucaccaucagcagagacaacagcaagaacacccuguaccugcagaugaacagccugagagccgaggacaccgccguguacuacugcgugaaggacgugggcgagagcgagaacgaggagugggccagcgacuacuacgacuucggcagagacuaccccggccaggacaccagagccguggugggcgccuucgacaucuggggccagggcaccauggugaccgugagcagc

SEQ ID NO: 32858 - RNA, 432 nt, Artificial Sequence
  derived and/or modified sequence opt4 from anti-HIV_cap256-038-196679_VR-Chain
gaggugcagcugcuggagagcggcggcggccuggugcagcccggcggcagccugagacugagcugcgccgccagcggcuucaccuucagcagcuacgccaugagcugggugagacaggcccccggcaagggccuggaguggguggccgugaucagcuacgacggcggcaacaaguacuacgccgacagcgugaagggcagauucaccaucagcagagacaacagcaagaacacccuguaccugcagaugaacagccugagagccgaggacaccgcccuguacuacugcgccaaggaccugggcgagagcgagaacgaggagugggccagcgacuacuacgacuucggcagagacuaccccggccaggacagcagaggcguggugggcaccuucgacguguggggccagggcaccauggugaccgugagcagc

SEQ ID NO: 32859 - RNA, 438 nt, Artificial Sequence
  derived and/or modified sequence opt4 from anti-HIV_cap256-038-196118_VR-Chain
caggugcagcugguggagagcggcggcggcguggugcagcccggcggcagccugagacugagcugcgccgccagcggcuucaccuucagcaccuacggcaugcacugggugagacaggcccccggcaagggccuggagugggugaccuucaucagaaacgacggcaccaacaaguacuacgccgacagcgugaagggcagauucaccaucagcagagacaacaccaagaacacccuguaccugcagauguacagccugagagccgaggacaccgccguguacuacugcgccaaggaccugggcgagagcgagaacgaggacgaggagugggccagcgacuacuacgacuucggcagagacuaccccggccaggacagcagaggcguggugggcaccuucgacauguggggccagggcaccauggugaccgugagcagc

SEQ ID NO: 32860 - RNA, 429 nt, Artificial Sequence
  derived and/or modified sequence opt4 from anti-HIV_cap256-038-195382_VR-Chain
caggugcaccugguggagagcggcggcggcguggugcagcccggcagaagccugagacugagcugcgccgccagcggcuucaccuucagcaacuaccccgugcacugggugagacaggcccccggcaagggccuggaguggguggccgugaucagcuucgacggcaucaacaacuacgccggcagcgugaagggcagauucaucaucagcagagacaacagcaagaacacccuguaccugcagaugaacagccugagagccgaggacaccgccguguacuacugcgugaaggaccugggcgagagcgagaaggaggaguggcccagcgacuacuacgacuucggcagagacuaccccggccaggacagcagaggcguggugggcguguucgacaucuggggccagggcaccauggugaccgugagcagc

SEQ ID NO: 32861 - RNA, 432 nt, Artificial Sequence
  derived and/or modified sequence opt4 from anti-HIV_cap256-038-180001_VR-Chain
gaggugcagcugguggagagcggcggcggccuggugcagcccggcagaagccugagacugagcugcaccgccagcggcuucaccuucggcgacuacgccaugagcugguucagacaggcccccggcaagggccuggaguggguggccgacaucagcuacgacggcagcaacaaguacuacgccgacagcgugaagggcagacugaccaucagcagagacaacagcaagaacacccuguaccugcagaugaacagccugagagccgaggacaccgccguguacuacugcgugaaggaccugggcgagagcgagaaggaggaguggcccagcgacuacuacgacuucggcagagacuaccccggccaggacagcagaggcguggugggcguguucgacaucuggggccagggcaccauggugaccgugagcagc

SEQ ID NO: 32862 - RNA, 432 nt, Artificial Sequence
  derived and/or modified sequence opt4 from anti-HIV_cap256-038-178021_VR-Chain
caggugaagcugguggagagcggcggcggcguggugcagcccggcggcagccugagacugagcugcgccgccgccggcuucaucuucagcaacagcggcaugcacugggugagacaggcccccgacaagggccuggaguggguggccuucgugcccuacgacggcagcaacaaguacuacgccgacagcgugaagggcagauucaccaucagcagagacaacagcaagaacacccugagccugcagaugaacagccugagaaccgaggacaccgccguguacuacugcgccaaggaccugggcgagagcgagaccgaggaguggcccagcgacuacuacgacuucggcagagacuaccccggccaggaccccagaggcguggugggcaccuucgacaucuggggccacggcaccauggugaccgugagcagc

SEQ ID NO: 32863 - RNA, 432 nt, Artificial Sequence
  derived and/or modified sequence opt4 from anti-HIV_cap256-038-177104_VR-Chain
gaggugcagcugcuggagagcggcggcggccuggugcagcccggcggcagccugagacugagcugcgccgccagcggcuucaccuucagcagcuacgccaugaacugggugagacaggcccccggcaagggccuggaguggguggccgugaucagcuacgacggcggcgacaaguacuacgccgacagcgugaagggcagauucaccaucagcagagacaacagcaagaacacccuguaccugcagaugaacagccugagaguggaggacaccgccguguacuacugcgugaaggacgugggcgagagcgagaacgaggagugggccagcgacuacuacgacuucggcagagacuaccccggccaggacaccagagccguggugggcgccuucgacaucuggggccagggcaccauggugaccgugagcagc

SEQ ID NO: 32864 - RNA, 432 nt, Artificial Sequence
  derived and/or modified sequence opt4 from anti-HIV_cap256-038-171261_VR-Chain
caggugcagcugguggagagcggcggcggcguggugcagcccggcagaagccugagacugagcugcgccgccagcggcuucaccuucagcagcuacgccauguacugggugagacaggcccccggcaagggccuggaguggguggccgugaucagcagcgacggcagcgacaagaacuacgccgacagcgugaagggcagauucaccaucagcagagacaacagcaacaacacccuguaccugcagaugaacagccugagagccgaggacaccgccguguacuacugcgccagagaccugggcgagagcgagaacgaggaguggcccagcgacuacuacgacuucggcagagacuaccccggccaggaccccagaggcgugaucggcaccuucgacguguggggccagggcaccauggugaccgugagcagc

SEQ ID NO: 32865 - RNA, 432 nt, Artificial Sequence
  derived and/or modified sequence opt4 from anti-HIV_cap256-038-169090_VR-Chain
caggugcagcugguggagagcggcggcggcguggugcagcccggcagaagccugagacugagcugcgccgccagcagauucaccuucaagaccuacaccaugcacugggugagacaggcccccggcaagggccuggaguggguggcccugaucagcuacgacggcagcaacaaguacuacgccgacagcgugaagggcagacugaccaucagcagagacaacagcaagaacacccuguaccugcagaugaacagccugagagccgaggacaccgccguguacuacugcgugaaggaccugggcgagagcgagaaggaggaguggcccagcgacuacuacgacuucggcagagacuaccccggccaggacagcagaggcguggugggcguguucgacaucuggggccagggcaccauggugaccgugagcagc

SEQ ID NO: 32866 - RNA, 432 nt, Artificial Sequence
  derived and/or modified sequence opt4 from anti-HIV_cap256-038-168705_VR-Chain
gaggugcagcugguggagagcggcggcggccuggugaagcccggcggcagccugagacugagcugcgccgccagcggcuucaccuucagcagcuacagcaugaacugggugagaagagcccccggcaagggccuggaguggguggcccugaucagcuacgacgagaacaagaaguacuacgccgacagcgugaagggcagauucaccaucagcagagagaacagcaagaacacccuguaccugcagaugaacagccugagagccgaggacaccgccguguacuacugcgccaaggaccugggcgagagagagaacgaggagugggccagcgacuacuacgacuucggcagagacuaccccggccaggaccccagaggcguggugggcagcaucgacaccuggggccacggcaccauggugaccgugagcagc

SEQ ID NO: 32867 - RNA, 432 nt, Artificial Sequence
  derived and/or modified sequence opt4 from anti-HIV_cap256-038-167685_VR-Chain
caggugcagcugguggagagcggcggcggcguggugcagcccggcagaagccugagacugagcugcgccgccagcggcaucaccuucagcagcuacgccauccacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacgacuucagcaucggcuaccccggccaggaccccagaggcguggugggcgccuucgacaucuggggccagggcaccauggugaccgugagccug

SEQ ID NO: 32868 - RNA, 432 nt, Artificial Sequence
  derived and/or modified sequence opt4 from anti-HIV_cap256-038-158775_VR-Chain
caggugcagcugguggagagcggcggcggcguggugcagcccggcggcagccugagacugagcugcgccgccagcggcuucaccuucagcaccuacggcaugcacugggugagacaggcccccggcaagggccuggaguggguggccuucaucagagacaacggcagcaacaaguacuacgccgacagcgugaagggcagauucaccaucagcagagacaacagcaagaacacccuguaccugcagaugaacagccugagagccgaggacaccgcccuguacuacugcgccaaggaccugggcgagagcgagaacgaggagugggccagcgacuacuacgacuucggcagagacuaccccggccaggacagcagaggcguggugggcaccuucgacguguggggccagggcaccauggugaccgugagcagc

SEQ ID NO: 32869 - RNA, 432 nt, Artificial Sequence
  derived and/or modified sequence opt4 from anti-HIV_cap256-038-157318_VR-Chain
cacgugcagcugguggagagcggcggcggcguggugcagcccggcagaagccugagacugagcugcgccgccagcggcaucaccuucagcaccuacgacaugcacugggugagacaggcccccggcaagggccuggaguggguggccgugaucagcaacgacggcagcaacaaguacuacgccgacagcgugaagggcagauucaccaucagcagagacaacagcaagaacacccuguaccugcagaugaacagccugagagccgaggacaccgcccuguacuacugcgccaaggaccugggcgagagcgagaaggaggagugggccagcgacuacuacgacuucggcagagacuaccccggccaggaccccagaggcgugguggccaccuucgacaucuggggccagggcaccauggugaccgugagcagc

SEQ ID NO: 32870 - RNA, 432 nt, Artificial Sequence
  derived and/or modified sequence opt4 from anti-HIV_cap256-038-153058_VR-Chain
caggugcagcugguggagagcggcggcggcguggugcagcccggcagaagccugagacugagcugcgccgccagcggcuucaccuucagcaccuacgccaugcacugggugagacaggcccccggcaagggccuggaguggguggccgugaucagcuacgacggcagccacagcuacuacgccggcagcgugaagggcagauucaccaccagcagagacaacagcaagaacacccugaaccugcagaugaacagccugagacccgaggacaccgcccuguacuacugcgccaaggaccugggcgagagcgagaacgaggagugggccagcgacuacuacgacuucggcagagacuaccccggccaggacagcagaggcguggugggcaccuucgacguguggggccagggcaccauggugaccgugagcagc

SEQ ID NO: 32871 - RNA, 432 nt, Artificial Sequence
  derived and/or modified sequence opt4 from anti-HIV_cap256-038-150027_VR-Chain
cuggugcagcugguggagagcggcggcggcguggugcagcccggcggcagccugagacugagcugcgccgccagcggcuucagauucagcagcuacggcaugcacugggugagacaggcccccggcaagggccuggaguggguggccuucaucagauacgacggcagcuucaaggacuacgccgacagcgugagaggcagauucaccaucagcagagacaacagcaagaacaccguguacgugcagaugaacagccugagagccgaggacaccgccguguacuacugcgccaaggaccugggcgagagcgagaacgaggagugggccaccgacuacuacgacuucgccaccggcuaccccgugcaggaccccagagccguggugggcgccuucgacaucuggggccagggcaccauggugaccgugagcccc

SEQ ID NO: 32872 - RNA, 432 nt, Artificial Sequence
  derived and/or modified sequence opt4 from anti-HIV_cap256-038-146372_VR-Chain
caggugcagcugguggagagcggcggcggcguggugcagcccggcagaagccugagacugagcugcgccgccagcggcuucaccuucagcagcuucggcaugcacugggugagacagagccccggcaagggccuggaguggguggccgugaucagcuacgacggcaacaacaaguacuacgccgacagcgugaagggcagauucaccaucagcagagagaacagcaagaacacccuguaccugcagaugaacagccugagaaccgacgacaccgccguguacuacugcgccaaggaccugggcgagagcgagaccgaggagugggccaccgacuacuacgacuucgccaccggcuaccccgugcaggaccccagagccguggugggcgccuucgacaucuggggccagggcaccauggugaccgugagcccc

SEQ ID NO: 32873 - RNA, 432 nt, Artificial Sequence
  derived and/or modified sequence opt4 from anti-HIV_cap256-038-141868_VR-Chain
gagcugagacugguggagagcggcggcaaccuggugcagcccggcggcagccugacccugagcugcguggccagcggcuucaccuucgacagcuacggcaugagcugggugagacaggcccccggcaagggccuggaguggguggcccugaucagcuacgacgagaacaagaaguacuacgccgacagcgugaagggcagauucaccaucagcagagagaacagcaagaacacccuguaccugcagaugaacagccugagagccgaggacaccgccguguacuacugcgccaaggaccugggcgagagagagaacgaggagugggccagcgacuacuacgacuucggcagagacuaccccggccaggaccccagaggcguggugggcagcaucgacaccuggggccacggcaccauggugaccgugagcagc

SEQ ID NO: 32874 - RNA, 432 nt, Artificial Sequence
  derived and/or modified sequence opt4 from anti-HIV_cap256-038-141616_VR-Chain
gaggugcagcugcuggagagcggcggcggccuggugcagcccggcggcagccugagacugagcugcgccgccagcggcuucaccuucagcagcuacgccaugagcugggugagacaggcccccggcaagggccuggaguggguggccgugaucagcaaggacggcagcgacaacagcuacguggacagcgugaagggcagauucaccaucagcagagacaacagcaagaacacccuguaccugcagaugaacagccugagagccgaggacaccgccguguacuacugcgccagagaccugggcgagagcgagaacgaggaguggcccagcgacuacuacgacuucggcagagacuaccccggccaggaccccagaggcgugaucggcaccuucgacguguggggccagggcaccauggugaccgugagcagc

SEQ ID NO: 32875 - RNA, 432 nt, Artificial Sequence
  derived and/or modified sequence opt4 from anti-HIV_cap256-038-127989_VR-Chain
caggcccagcugguggagagcggcggcggcguggugcagcccggcagaagccugagacugagcugcgccgccagcggcuucaccuucagcaacuucgccaugcacugggugagacaggcccccggcaagggccuggaguggguggccgugaugagcgacgacggcagcaacaaguacuacgccgacagcgugaagggcagauucaccaucagcagagacaacagcgagaacacccuguaccugcagaugaacagccugagagccgaggacaccgccguguacuacugcgccaaggaccugggcgagagcgagaccgaggagugggccaccgacuacuacgacuucggcaccggcuaccccggccaggaccccagagccaugaucggcaccuucgacaucuggggcagaggcaccauggugaccgugagcagc

SEQ ID NO: 32876 - RNA, 432 nt, Artificial Sequence
  derived and/or modified sequence opt4 from anti-HIV_cap256-038-118109_VR-Chain
caggugcagcugguggagagcggcggcggcguggugcagcccggcggcagccugagacugagcugcaccgccagcggcuucaccuucagcgccuacgacaugcacuggaucagacaggcccccggcaagggccugggcuggguggccuucaucaccaacgagggcagcagcaagaacuacguggacagcgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacgacuucagcaucgccuaccccggccaggaccccagaggcguggugggcaucuucgacaucuggggccagggcaccauggugaccgugagcagc

SEQ ID NO: 32877 - RNA, 432 nt, Artificial Sequence
  derived and/or modified sequence opt4 from anti-HIV_cap256-038-112226_VR-Chain
gaggugcagcugguggagagcggcggcggccuggugcagcccggcggcagccugagacugagcugcgccgccagcggcuucaccuucagcagcuacuggaugaccugggugagacaggcccccggcaagggccuggaguggguggccgugaucagcgacgacggcaacaacaaguacuacgccgacagcgugaagggcagauucaccaucagcagagacaacagcaagaacacccuguaccugcagaugaacagccugagaguggaggacaccgccguguacuacugcgugaaggacgugggcgagagcgagaacgaggagugggccagcgacuacuacgacuucggcagagacuaccccggccaggacaccagagccguggugggcgccuucgacaucuggggccagggcaccauggugaccgugagcagc

SEQ ID NO: 32878 - RNA, 432 nt, Artificial Sequence
  derived and/or modified sequence opt4 from anti-HIV_cap256-038-105918_VR-Chain
gaggugcagcugcuggagagcggcggcggccuggugcagcccggcggcagccugagacugagcugcgccgccagcggcuucaccuucaacauccaccccaugcacugggugagacaggcccccggcaagggccuggaguggguggccgugaucagcuacgacggcaacaacaaguacuacgccgacagcgugaagggcagauucaccaucagcagagagaacagcaagaacacccuguaccugcagaugaacagccugagaaccgacgacaccgccguguacuacugcgccaaggaccugggcgagagcgagaccgaggaguggcccagcgacuacuacgacuucggcagagacuaccccggccaggaccccagaggcguggugggcaccuucgacaucuggggccacggcaccauggugaccgugagcagc

SEQ ID NO: 32879 - RNA, 432 nt, Artificial Sequence
  derived and/or modified sequence opt4 from anti-HIV_cap256-038-104487_VR-Chain
cuggugcagcugguggagagcggcggcggcguggugcagcccggcaagagccugagacugagcugcgccgccagcggcuucaccuucagcagcuacgccaugcacuggaucagacaggcccccggcaagggccuggaguggguggccgugaucagcgacgacggcagcaucaagaacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacggcuucagcaucggcuaccccggccaggaccccagaggcguggugggcaucuucgacaucugggcccagggcaccauggugaccgugagcagc

SEQ ID NO: 32880 - RNA, 432 nt, Artificial Sequence
  derived and/or modified sequence opt4 from anti-HIV_cap256-038-102308_VR-Chain
caggugcagcugguggagagcggcggcggcguggugcagcccggcggcagccugagacugagcugcgccgcccuggacuuccccuucagcagcuucggcaugcacugggugagacagacccccggcagaggccuggaguggguggccaucaucuggagcgacggcagcaacagauacuacguggacagcgugaagggcagauucaccaucagcagagacaacagcaagaacacccuguaccugcagaugaacagccugagacccgacgacaccgccguguacuacugcgugaaggaccugggcgagagcgagaacgaggagugggccaccgacuacuacgacuucagcgugggcuaccccggccagggccccagaggcguggugggcaucuucgacaucuggggccagggcaccauggugaccgugagcagc

SEQ ID NO: 32881 - RNA, 432 nt, Artificial Sequence
  derived and/or modified sequence opt4 from anti-HIV_cap256-038-091115_VR-Chain
caggugcagcugguggagagcggcggcggcguggugcagcccggcagaagccugagacugagcugcgccgugagcggcuucaccuucagcagcuacggccugcacugggugagacaggcccccggcaagggccuggaguggguggccgugaucagcuacgacggcagcaacaaguacuacgccgacagcgugaagggcagauucaccaucagcagagacaacagcaagaacacccuguaccugcagaucaacagccugagagccgaggacaccgccguguacuacugcgccaaggaccugggcgagagcgagaacgaggagugggccaccgacuacuacgacuucagcaucggcuaccccggccaggaccccagagccguggugggcgccuucgacaucuggggccagggcaccauggugaccgugagcagc

SEQ ID NO: 32882 - RNA, 432 nt, Artificial Sequence
  derived and/or modified sequence opt4 from anti-HIV_cap256-038-090262_VR-Chain
caggugcagcugguggagagcggcggcggcguggugcaggccggcggcagccugagacugagcugcgccgccagcggcuucaccuucaacaacuacggcaugcacugggugagacaggcccccggcaagggccuggagugggccgccuucaucagauacgacggcagcaacaaguacuacgccgacagcgugagaggcagauucaccaucagcagagacaacagcaagaacacccuguaccugcagaugaacagccugagagccgaggacaccgccguguacuacugcgugaaggacgugggcgagagcgagaacgaggagugggccagcgacuacuacgacuucggcagagacuaccccggccaggacaccagagccguggugggcgccuucgacaucuggggccagggcaccauggugaccgugagcagc

SEQ ID NO: 32883 - RNA, 432 nt, Artificial Sequence
  derived and/or modified sequence opt4 from anti-HIV_cap256-038-083260_VR-Chain
caggugcagcugguggagagcggcggcggccuggugaagcccggcggcagccugagacugagcugcgccgccagcggcuucaccuucagcgacuacuacaugaccuggaucagacaggcccccggcaagggccuggaguggguggccgugaucagcuacgacggcggcaacaaguacuacgccgacagcgugaagggcagauucaccaucagcagagacaacagcaagaacacccuguaccugcagaugaacagccugagagccgaggacaccgcccuguacuacugcgccaaggaccugggcgagagcgagaacgaggagugggccagcgacuacuacgacuucggcagagacuaccccggccaggacagcagaggcguggugggcaccuucgacguguggggccagggcaccauggugaccgugagcagc

SEQ ID NO: 32884 - RNA, 432 nt, Artificial Sequence
  derived and/or modified sequence opt4 from anti-HIV_cap256-038-080981_VR-Chain
caggugcagcugguggagagcggcggcggcguggugcagcccggcagaagccugagacugagcugcgccgccagcggcuucaccuucagcagcuacggcaugcacugggugagacaggcccccggcaagggcauggaguggguggccgugaucagcuacgacggcagcaacaaguacuacgccgacagcgugaagggcagauucaccaucagcagagacaacagcaagaacacccuguaccugcagaugaacagccugagagccguggacaccgccguguacuacugcgccaaggaccugggcgagggcgagaacgaggagugggccaccgacuacuacgacuucagcaucggcuaccccggccaggaccccagaggcguggugggcgccuucgacaucuggggccagggcaccauggugaccgugagcagc

SEQ ID NO: 32885 - RNA, 432 nt, Artificial Sequence
  derived and/or modified sequence opt4 from anti-HIV_cap256-038-080873_VR-Chain
cuggugcagcugguggagagcggcggcggcguggugcagcccggcggcagccugagacugagcugcgccgccagcggcuucagauucagcagcuacggcaugcacugggugagacaggcccccggcaagggccuggaguggguggccuucaucagauacgacggcagcuucaaggacuacgccgacagcgugagaggcagauucaccaucagcagagacaacagcaagaacaccguguaccugcagaugaacagccugagagccgaggacaccgccguguacuacugcgugaaggaccugggcgagagcgagaaggaggaguggcccagcgacuacuacgacuucggcagagacuaccccggccaggacagcagaggcguggugggcguguucgacaucuggggccagggcaccauggugaccgugagcagc

SEQ ID NO: 32886 - RNA, 432 nt, Artificial Sequence
  derived and/or modified sequence opt4 from anti-HIV_cap256-038-074413_VR-Chain
caggugcagcugguggagagcggcggcggcguggugcagcccggcggcagccugagacugagcugcgccgccagcggcuucaccuucagcaccuacggcaugcacugggugagacagccccccggcaagggccuggaguggguggccuucaucagauacgacggcagcaacaccuacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccagcgacuacuacgacuucggcagagacuaccccggccaggaccccagaggcguggugggcguguucgacaucuggggccagggcaccauggugaccgugagcagc

SEQ ID NO: 32887 - RNA, 432 nt, Artificial Sequence
  derived and/or modified sequence opt4 from anti-HIV_cap256-038-073153_VR-Chain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggcccugaucagcuacgacggcaccaacaaguacuacgccgacagcgugaagggcagauucaccaucagcagagacaacagcaagaacacccuguuccugcagaugaacagccugagagccgaggacaccgcccuguacuacugcgccaaggaccugggcgagagcgagaacgaggagugggccagcgacuacuacgacuucggcagagacuaccccggccaggaccccagaggcguggugggcaccuucgacaucuggggccagggcaccauggugaccgugagcagc

SEQ ID NO: 32888 - RNA, 432 nt, Artificial Sequence
  derived and/or modified sequence opt4 from anti-HIV_cap256-038-064227_VR-Chain
gaggugcaggugguggagagcggcggcggccuggugcagcccggcggcagccugagacugagcugcgccgccagcggcuucaccuucagcaacuacuggaugagcugggugagacaggcccccggcaagggccuggaguggguggccgugaugagcuucagcggcagcggcagcuacuacgccgacagcgugaagggcagauucaccaucagcagcgacgacagcaugaacaccguguaccugcagaugaacagccugagagccgaggacaccgccguguacuacugcgccaaggaccugggcgagagagagaacgaggagugggccagcgacuacuacgacuucggcagagacuaccccggccaggaccccagaggcguggugggcagcaucgacaccuggggccacggcaccauggugaccgugagcagc

SEQ ID NO: 32889 - RNA, 432 nt, Artificial Sequence
  derived and/or modified sequence opt4 from anti-HIV_cap256-038-061640_VR-Chain
caggugcagcugguggagagcggcggcggcguggugcagcccggcagaagccugagacugagcugcaccgccagcagauucagcuucaacaacuacgccaugcacugggugagacaggcccccggcaagggccuggaguggguggccaucaucagcaaggacggcagcgacaacagcuacguggacagcgugaagggcagauucaccaucagcagagacaacagcaagaacacccuguaccugcagaugaacagccugagagccgaggacaccgccguguacuacugcgccagagaccugggcgagagcgagaacgaggaguggcccagcgacuacuacgacuucggcagagacuaccccggccaggaccccagaggcgugaucggcaccuucgacguguggggccagggcaccauggugaccgugagcagc

SEQ ID NO: 32890 - RNA, 414 nt, Artificial Sequence
  derived and/or modified sequence opt4 from anti-HIV_cap256-038-059482_VR-Chain
agaggcgugcagugccaggugcagcugguggagagcggcggcggcguggugcagcccggcuucaccuucagcagcuacgugaugcacugggugagacaggcccccggcaagggccuggaguggguggccgacaucagcuacgacggcagcaacaaguacuacgccgacagcgugaagggcagacugaccaucagcagagacaacagcaagaacacccuguaccugcagaugaacagccugagagccgaggacaccgccguguacuacugcgugaaggaccugggcgagagcgagaaggaggaguggcccagcgacuacuacgacuucgccaccggcuaccccgugcaggaccccagagccguggugggcgccuucgacaucuggggccagggcaccauggugaccgugagcccc

SEQ ID NO: 32891 - RNA, 432 nt, Artificial Sequence
  derived and/or modified sequence opt4 from anti-HIV_cap256-038-054000_VR-Chain
gaggugcagcugguggagagcggcggcagcguggugagacccggcggcagccugagacugagcugcgccgccagcggcuucaccuucgacgacagcggcaugagcugggugagacagggccccggcaagggccuggaguggguggccgugaucagcuacgacggcggcaacaaguacuacgccgacagcgugaagggcagauucaccaucagcagagacaacagcaagaacacccuguaccugcagaugaacagccugagagccgaggacaccgcccuguacuacugcgccaaggaccugggcgagagcgagaacgaggagugggccagcgacuacuacgacuucggcagagacuaccccggccaggacagcagaggcguggugggcaccuucgacguguggggccagggcaccauggugaccgugagcagc

SEQ ID NO: 32892 - RNA, 432 nt, Artificial Sequence
  derived and/or modified sequence opt4 from anti-HIV_cap256-038-050554_VR-Chain
gaggugcagcugcuggagagcggcggcgaccuggugcagagcggcggcagccugagacugagcugcguggccagcggcuucaccuucagcacccacgccaugaccugggugagacaggcccccggcaagggccuggaguggguggccgugaucagcagcgacggcagcaacaagaacuucgccgacagcgugaagggcagauucaccaucagcagagacaacagcaagaacacccuguaccugcagaugaacagccugagacccgaggacaccgccguguacuacugcgccaaggaccugggcgagagcgagaacgaggagugggccaccgacuacuacgacuucagcaccggcuaccccgugcaggaccccagagccguggugggcgccuucgacaucuggggccagggcaccauggugaccgugagcagc

SEQ ID NO: 32893 - RNA, 432 nt, Artificial Sequence
  derived and/or modified sequence opt4 from anti-HIV_cap256-038-044256_VR-Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgugaucagcuacgacggcagcaacaaguaccacgccggcagcgugaagggcagauucaucaucagcagagacaacagcaagaacacccuguaccugcagaugaacagccugagagccgaggacaccgcccuguacuacugcgccaaggaccugggcgagagcgagaacgaggagugggccagcgacuacuacgacuucggcagagacuaccccggccaggaccccagaggcguggugggcaccuucgacaucuggggccagggcaccauggugaccgugagcagc

SEQ ID NO: 32894 - RNA, 432 nt, Artificial Sequence
  derived and/or modified sequence opt4 from anti-HIV_cap256-038-040944_VR-Chain
caggugcagcugguggagagcggcggcggcguggugcagcccggcagaagccugagacugagcugcgccgccagcggcuucaccuucagcaacuacgccauggacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacgacuucagcaccggcuaccccggccaggaccccagagccguggugggcgccuucgacaucuggggccagggcaccauggugaccgugagcagc

SEQ ID NO: 32895 - RNA, 432 nt, Artificial Sequence
  derived and/or modified sequence opt4 from anti-HIV_cap256-038-040090_VR-Chain
caggugcagcugguggagagcggcggcggcguggugcagcccggcagaagccugagacugagcugcgccgccagcggcuucagcuucagcaacuacgccauggacugggugagacaggcccccggcaagggccuggaguggguggccgugaucagcagcgacggcagcaacaagaacuacgccgacagcgugaagggcagauucaccaucagcagagacaacagcaagaacacccuguaccugcagauggacagccugagagccgacgacaccgccguguacuacugcgccaaggaccugggcgagagcgagaacgaggagugggccaccgacuacuacgacuucagcaucggcuaccccgugcaggaccccagaggcguggugggcaucuucgacaucuggggccagggcaccauggugaccgugagcagc

SEQ ID NO: 32896 - RNA, 432 nt, Artificial Sequence
  derived and/or modified sequence opt4 from anti-HIV_cap256-038-032874_VR-Chain
caggugcagcugguggagagcggcggcggcguggugcagcccggcggcagccugagacugagcugcgccgccagcggcuucaccuucagcagcuacggcaugcacugggugagacaggcccccggcaagggccuggaguggguggccuucaucagauacgacggcaacaacaaguacuacgccgacagcgugaagggcagauucaccaucagcagagagaacagcaagaacacccuguaccugcagaugaacagccugagagccgaggacaccgccguguaccacugcgccaaggaccugggcgagagcgagaaggaggagugggccagcgacuacuacgacuucggcagagacuaccccggccaggaccccagaggcguggugggcaccuucgacaucuggggccacggcaccauggugaccgugagcagc

SEQ ID NO: 32897 - RNA, 432 nt, Artificial Sequence
  derived and/or modified sequence opt4 from anti-HIV_cap256-038-025899_VR-Chain
caggugcagcugguggagagcggcggcggcguggugcagcccggcagaagccugagacugagcugcguggccagcggcuucaccuucagcaacuacgccauguacugggugagacaggcccccggcaagggccuggagugggugaccaucaucagcuucgacggcagcaaccaguacuacgccgacagcgugaagggcagauucaccaucagcagagagaacagcaagaacacccuguaccugcagaugaacagccugagagccgaggacaccgccguguacuacugcgccaaggaccugggcgagagagagaacgaggagugggccagcgacuacuacgacuucggcagagacuaccccggccaggaccccagaggcguggugggcagcaucgacaccuggggccacggcaccauggugaccgugagcagc

SEQ ID NO: 32898 - RNA, 432 nt, Artificial Sequence
  derived and/or modified sequence opt4 from anti-HIV_cap256-038-024581_VR-Chain
cacauccagcugguggagagcggcggcggcguggugcagcccggcggcagccugagacugagcugcgccgccagcggcuuccccuucagcagcuucggcaugcacugggugagacagacccccggcagaggccuggaguggguggccaucaucuggagcgacggcagccacaaggaguacaccgacagcgugaagggcagauucaccaucagcagagacaacagcagaagcaccauggaccugcagaugaacaaccugagacccgaggacaccgccguguacuacugcgccaaggaccugggcgagagagagaacgaggagugggccagcgacuacuacgacuucggcagagacuaccccggccaggaccccagaggcguggugggcagcaucgacaccuggggccacggcaccauggugaccgugagcagc

SEQ ID NO: 32899 - RNA, 432 nt, Artificial Sequence
  derived and/or modified sequence opt4 from anti-HIV_cap256-038-013345_VR-Chain
caggugcagcugguggagagcggcggcggcguggugcagcccggcagaagccugagacugagcugcgccgugagcggcuucaccuucagcagcuacggcaugcacugggugagacaggcccccggcaagggccuggaguggguggccgccaucagcuacgacggcagcaacaaguacuacguggacagcgugaagggcagauucaccaucagcagagacaacagcaagaacacccuguaccugcagaugaacagccugagagccgaggacaccgccguguacuacugcgccagagaccugggcgagagagagaucgaggagugggccaccgacuacuacgacuucagcaucggcuaccccggccaggaccccagaggcguggugggcguguucgacaucuggggccagggcaccauggugaccgugagcagc

SEQ ID NO: 32900 - RNA, 438 nt, Artificial Sequence
  derived and/or modified sequence opt4 from anti-HIV_cap256-038-011559_VR-Chain
caggugcagcugguggagagcggcggcggcguggugcagcccggcagaagccugagacugagcugcgaggccagcggcuucaccuucagcagcuacggcauggacugggugagacaggcccccggcaagggccuggaguggguggcccugaucagccacgacggcagcaacaagcacuacgccgacagcgugaagggcagauucaccaucagcagagacaacagcagaaacacccuguaccugcagaugaacagccugagagccgaggacaccgcccuguacuacugcgccaaggaccugggcgagagcgagaacgaggacgaggagugggccagcgacuacuacgacuucggcagagacuaccccggccaggacagcagaggcguggugggcaccuucgacauguggggccagggcaccauggugaccgugagcagc

SEQ ID NO: 32901 - RNA, 432 nt, Artificial Sequence
  derived and/or modified sequence opt4 from anti-HIV_cap256-038-009634_VR-Chain
caggugcagcugguggagagcggcggcggcguggugcagcccggcagaagccugagacugagcugcgccgccagcggcuucaccuucaccagcuucggcaugcacugggugagacaggcccccggcaagggccuggaguggguggccgugaucagcuacgacggcaacaacaaguacuacgccgacagcgugaagggcagauucaccaucagcagagagaacagcaagaacacccuguaccugcagaugaacagccugagagccgaggacaccgccguguaccacugcgccaaggaccugggcgagagcgagaucgaggaguggaccagcgacuacuacgacuucggcagagacuaccccggccaggaccccagaggcguguucggcaccuucgacaucuggggccacggcaccauggugaccgugagcagc

SEQ ID NO: 32902 - RNA, 432 nt, Artificial Sequence
  derived and/or modified sequence opt4 from anti-HIV_cap256-038-006730_VR-Chain
caggugcagcugguggagagcggcggcggcguggugcagcccggcagaagccugagacugagcugcgccgccagcggcuucaccuucagcagcuucggcaugcacugggugagacaggcccccggcaagggccuggaguggguggccgugaucagcaaggacggcagcgacaacagcuacguggacagcgugaagggcagauucaccaucagcagagacaacagcaagaacacccuguaccugcagaugaacagccugagagccgaggacaccgccguguacuacugcgccagagaccugggcgagagcgagaacgaggaguggcccagcgacuacuacgacuucggcagagacuaccccggccaggaccccagaggcgugaucggcaccuucgacguguggggccagggcaccauggugaccgugagcagc

SEQ ID NO: 32903 - RNA, 432 nt, Artificial Sequence
  derived and/or modified sequence opt4 from anti-HIV_cap256-038-004887_VR-Chain
caggugcagcugguggagagcggcggcggcguggugcagcccggcagaagccugagacugagcugcgccgccagcggcuucagcuucagcaccagcggcaugcacugggugagacaggcccccggcaagggcauggaguggguggccgugaucagcuacgacggcagcaacaaguacuacgccgacagcgugaagggcagauucaccaucagcagagacaacagcaagaacacccuguaccugcagaugaacagccugagagccguggacaccgccguguacuacugcgccaaggaccugggcgagggcgagaacgaggagugggccaccgacuacuacgacuucagcaucggcuaccccgugcagaaccccagaggccuggugggcgccuucgacaucuggggccagggcaccauggugaccgugagcagc

SEQ ID NO: 32904 - RNA, 432 nt, Artificial Sequence
  derived and/or modified sequence opt4 from anti-HIV_cap256-038-004840_VR-Chain
caggugcagcugguggagagcggcggcggcguggugcagcccggcagaagccugagacugagcugcgccgccagcggcuucaccuucagcagcuucggcaugcacugggugagacagagccccggcaagggccuggaguggguggccgugaucagcuacgacggcaacaacaaguacuacgccgacagcgugaagggcagauucaccaucagcagagagaacagcaagaacacccuguaccugcagaugaacagccugagaaccgacgacaccgccguguacuacugcgccaaggaccugggcgagagcgagaccgaggaguggcccagcgacuacuacgacuucggcagagacuaccccggccaggaccccagaggcguggugggcaccuucgacaucuggggccacggcaccauggugaccgugagcagc

SEQ ID NO: 32905 - RNA, 432 nt, Artificial Sequence
  derived and/or modified sequence opt4 from anti-HIV_cap256-038-002181_VR-Chain
gaggugcagcugguggagagcggcggcggccuggugcagcccggcagaagccugagacugagcugcgccgccagcggcuucaccuucgaggacuacgccaugcacugggugagacaggcccccggcaagggccuggaguggguggccgugaucagcuacgacggcagcaacaaguacuacguggacagcgugaagggcagauucaccaucagcagagacaacagcaagaacacccuguaccugcagaugaacagccugagagccgaggacaccgccguguacuacugcgccaaggaccugggcgagagcgagaacgaggagugggccaccgacuacuacgacuucagcaucggcuaccccggccaggaccccagaggcguggugggcaucuucgacaucuggggccagggcaccauggugaccgugagcagc

SEQ ID NO: 32906 - RNA, 432 nt, Artificial Sequence
  derived and/or modified sequence opt4 from anti-HIV_cap256-038-001902_VR-Chain
caggugcagcugguggagagcggcggcggcguggugcagcccggcagaagccugagacugagcugcgccgccagcggcuucaccuucagcagcuucggcaugcacugggugagacaggcccccggcaagggccuggaguggguggccgugaucagcuacgacggcaacaacaaguacuacgccgacagcgugaagggcagauucaccaucagcagagagaacagcgagaacacccuguaccugcagaugaacagccugagagccgacgacaccgccguguacuacugcgccaaggaccugggcgagagcgagaacgaggagugggccagcgacuacuacgacuucggcagagacuaccccggccaggacaccagaggcguggugggcaccuucgacaucuggggccacggcaccauggugaccgugagcagc

SEQ ID NO: 32907 - RNA, 432 nt, Artificial Sequence
  derived and/or modified sequence opt4 from anti-HIV_cap256-038-000976_VR-Chain
caggugcagcugguggagagcggcggcggcguggugcagcccggcagaagccugagacugagcugcgccgccagcggcuucaccuucagcagcuucggcaugcacugggugagacaggcccccggcaagggccuggaguggguggccgugaucagcgacgacggcaacaacaaguacuacgccgacagcgugaagggcagauucaccaucagcagagacaacagcaagaacacccuguaccugcagaugaacagccugagaguggaggacaccgccguguacuacugcgugaaggacgugggcgagagcgagaacgaggagugggccagcgacuacuacgacuucggcagagacuaccccggccaggacaccagagccguggugggcgccuucgacaucuggggccagggcaccauggugaccgugagcagc

SEQ ID NO: 32908 - RNA, 432 nt, Artificial Sequence
  derived and/or modified sequence opt4 from anti-HIV_cap256-038-000384_VR-Chain
caggugcagcugguggagagcggcggcggcguggugcagcccggcaagagccugagacugagcugcgccgccagcggcuucaccuucagcagcuacgugaugcacugggugagacaggcccccggcaagggccuggaguggguggccgacaucagcuacgacggcagcaacaaguacuacgccgacagcgugaagggcagacugaccaucagcagagacaacagcaagaacacccuguaccugcagaugaacagccugagagccgaggacaccgccguguacuacugcgugaaggaccugggcgagagcgagaaggaggaguggcccagcgacuacuacgacuucggcagagacuaccccggccaggacagcagaggcguggugggcguguucgacaucuggggccagggcaccauggugaccgugagcagc

SEQ ID NO: 32909 - RNA, 321 nt, Artificial Sequence
  derived and/or modified sequence opt4 from anti-HIV_206-314431_VR-Chain
caguucgugcugacccagccccccagcgugagcgccgcccccggccagaacgugaccaucagcugcagcggcccccccagccacaucgagaagaacgacgugagcugguaccagagacugcccggcauggcccccaagauggugaucuacgagagcagaagaagaccccugggcauccccgugagauucaccgccagcagaagcggcagcagcgccacccuggugaucaccggccugcagaccgccgacgaggccgacuacuacugcggcaccugggacggcagaaugaacuucggcaccggcaccaccgugaccgugcug

SEQ ID NO: 32910 - RNA, 321 nt, Artificial Sequence
  derived and/or modified sequence opt4 from anti-HIV_206-247594_VR-Chain
cagagcauccugacccagccccccagcgugagcgccgcccccggccagaacgugaccaucagcugcagcggcccccccagccacaucgagaagaacgacgugagcugguaccagagauuccccggcauggcccccaagaugaucaucuacgagagcaagagaagacccuucggcgugcccggcagauucagcgccagcagaagcggcaagagcgccacccuggccaucaccggccugcagaccggcgacgaggccgacuacuacugcggcaccugggacggcagaaugaacuucggcaccggcaccaccgugaccgugcug

SEQ ID NO: 32911 - RNA, 321 nt, Artificial Sequence
  derived and/or modified sequence opt4 from anti-HIV_206-116890_VR-Chain
cagagcgugcugacccagccccccagcgugagcgccgcccccggccagaacgugaccaucagcugcagcggcccccccagccacaucgagaagaacgacgugagcugguaccagcaccugcccggcgaggcccccaagaugaucaucuacgagagcuggagaagacccgccggcauccccgccagauucagcgccagcagaagcggcaagagcggcacccuggccaucaccggccugcagaccggcgacgaggccgacuacuacugcggcaccuggaacggcagaaugaacuucggcaccggcaccaccgugaccgugcug

SEQ ID NO: 32912 - RNA, 333 nt, Artificial Sequence
  derived and/or modified sequence opt4 from anti-HIV_206-072383_VR-Chain
cagagcgugcugacccagccccccagcgugagcgccgcccccggccagagagugaucaucagcugcagcggcaacaacagcaccaucggcaacaacuucgugagcugguaccagcaggugcccggcaccgcccccaagcugcugaucuacgagaccaacagaagacccagcggcauccccgacagauucagcggcagcaagagcggcaccagcgccacccuggccaucagcggccugcagaccggcgacgaggccgacuucuacugcaccguguggggcgugagaaagggcguggccgccguguucggcaccggcaccagacugaccgugcug

SEQ ID NO: 32913 - RNA, 333 nt, Artificial Sequence
  derived and/or modified sequence opt4 from anti-HIV_206-037527_VR-Chain
cagagcgugcugacccagccccccagcgugagcgccgcccccggccagaaggugaucaucagcugcagcggcaacaacagcaccaucggcaagauccuggugagcugguaccagcaggugcccggcaccgcccccaagcuggugaucuacgagaccaacagaagacccagcggcauccccgacagauucagcggcagcaagagcggcaccagcgccacccuggccaucaccggccugcagaccggcgacgaggccgacuacuucugcaagguguggggcgugagaaagggcguggccgccguguucggcaccggcaccaaggugaccgugcug

SEQ ID NO: 32914 - RNA, 333 nt, Artificial Sequence
  derived and/or modified sequence opt4 from anti-HIV_206-009095_VR-Chain
cagagcgugcugacccagccccccagcgugagcgccgcccccgcccagagagugaucaucagcugcagcggcgacaacagcaccaucggcaacaacuucgugagcugguaccagcaggugcccggcgccgcccccaagcugcugaucuacgagaccaacagaagacccagcggcauccccgacagauucagcggcagcaagagcggcaccaccgccacccuggccaucagcggccugcagaccggcgacgaggccgacuaccacugcaccguguggggcgugagaaagggcguggccgccguguucggcaccggcaccaaggugaccgugcug

SEQ ID NO: 32915 - RNA, 321 nt, Artificial Sequence
  derived and/or modified sequence opt4 from anti-HIV_176-503620_VR-Chain
cagagcgugcugacccagccccccagcgugagcaccgcccccggccagaccgugaccgugagcugcagcggcggcaccagcaacaccggcaacaacuucgugagcugguaccagcaccugcccggcaccgcccccaagcugcugaucuacgagaacaacaagagaccccugggcgugcccgacagauucagcggcgccaagagcggcaccagcgccacccuggcccugaccggccugcagaccggcgacgagggcgacuacuacugcgccaccuggagcggcagccugaacaucggcaccggcaccaaggugagcgugcug

SEQ ID NO: 32916 - RNA, 321 nt, Artificial Sequence
  derived and/or modified sequence opt4 from anti-HIV_176-478726_VR-Chain
cagagcgugcugacccagccccccagcgugagcgccgcccccggccagaacgugaacaucagcugcagcggcccccccagccacaucgagagaaacgacgugagcugguaccagcaccugcccggcgccgcccccaagaugaucaucuacgagagcuggagaagacccgccggcauccccgacagauucagcgccagcagaagcggcgccagcgccacccuggccaucaccggccugcagaccggcgacgaggccgacuacuacugcggcaccuggaacggcagaaugaacuucggcaccggcaccaccgugaccgugcug

SEQ ID NO: 32917 - RNA, 321 nt, Artificial Sequence
  derived and/or modified sequence opt4 from anti-HIV_176-245056_VR-Chain
cagagcgugcugacccagccccccagcgugagcgccgcccccggccagaacgugaccaucagcugcagcggcccccccagccacaucgagaagaacggcgugagcugguaccagcaguuccccggcauggcccccaagauggugaucuacgagagcaagagaagacccuucggcgugcccgccagauucagcgccagcagaagcggcaagagcgccacccuggccaucaccggccugcagaccggcgacgaggccgacuacuacugcggcaccugggacggcagaaugaacuucggcaccggcaccaccgugaccgugcug

SEQ ID NO: 32918 - RNA, 321 nt, Artificial Sequence
  derived and/or modified sequence opt4 from anti-HIV_176-164413_VR-Chain
cagagcgugcugacccagccccccagcgugagcgccgcccccggccagaaggugaccaucagcugcagcggcggcaccagcaacaucggcaacaacuacgugagcugguaccagagacugcccggcaccgcccccaagcugcugaucuacgagaacaacaagagacccagcggcauccccgacagauucagcggccccaagagcggcaccagcgccacccuggccaucaccggccugcagcccggcgacgaggccgacuacuacugcgccaccuggagcggcagccugaacuucggcaccggcaccaaggugaccgugcug

SEQ ID NO: 32919 - RNA, 333 nt, Artificial Sequence
  derived and/or modified sequence opt4 from anti-HIV_176-094308_VR-Chain
cagagcgugcugacccagccccccagcgugagcgccgcccccggccagaaggugaucaucagcugcagcggcaacaacagcaccaucggcaacaacuucgugagcugguaccagcaggugcccggcaccgcccccaagcugcugguguacgagaccuacagaagacccagcggcauccccgacagaagcagcggcagcaagagcggcaccaccgccacccaggccaucagcggccugcagaccggcgacgaggccgacuaccacugcaccguguggggcgugagaaagggcguggccgccguguucggcaccggcaccaaggugaccgugcug

SEQ ID NO: 32920 - RNA, 333 nt, Artificial Sequence
  derived and/or modified sequence opt4 from anti-HIV_176-065321_VR-Chain
cagagcgugcugacccagccccccagcgugagcgccgcccccggcagaagagugaucaucagcugcagcggcaacaacagcaccaucggcaacaacuucgugagcugguaccagcaggugcccggcaccgcccccaagcugcugguguacgagaccaacagaagacccagcggcauccccgacagauucagcggcagcaagagcggcaccagcgccacccuggccaucagcggccugcagaccggcgacgaggccgacuacuacugcaccguguggggcgugagaaagggcguggccgccguguucggcaccggcaccaaggugaccgugcug

SEQ ID NO: 32921 - RNA, 324 nt, Artificial Sequence
  derived and/or modified sequence opt4 from anti-HIV_119-099719_VR-Chain
cagagcgugcugacccagccccccagcgugagcgccgcccccggccagaaggugaccaucagcugcagcggcagcaacagcuacaucggcaacaaguacaucagcugguaccagcaguuccccggcaccgcccccaagcugcugaucuacgagaacaacaagagacccagcggcgugcccgacagauucagcgccagcaagagcgccaccagcgccacccuggccaucaccggccugcacaccggcgacgaggccgacuacuacugcgagaccugcgacggcagcggcggcguguucggcaccggcaccaaggugaccgugcug

SEQ ID NO: 32922 - RNA, 327 nt, Artificial Sequence
  derived and/or modified sequence opt4 from anti-HIV_119-099536_VR-Chain
gagcugacccagccccccagcgugagcgccgccagcggccagaacgugaacaucagcugcagcggcggcagcagcaacaucggcagcaacuacgugagcugguaccagcaguuccccggcaccgcccccaagcugcugaucuacgagaccaacaagagacccagcggcauccccgacagauucagcggcagcaagagcggcgccagcgccacccuggccaucaccggccugcagaccggcgacgaggccgacuacuacugcgccaccugggccgacagccugaacagcgccagaguguucggcaccggcaccaaggugaccgugcug

SEQ ID NO: 32923 - RNA, 333 nt, Artificial Sequence
  derived and/or modified sequence opt4 from anti-HIV_119-098907_VR-Chain
cagagcgugcugacccagccccccagcgugagcgccacccccggccagaaggugaccaucagcugcagcggcagcaacagcaacaucggcgacaaguacgugagcugguaccagcacuuccccggcaccgcccccaagcugcugguguacgagaccuacagaagacccagcggcauccccgacagauucagcggcagcaagagcggcaccagcgccacccuggccaucaccggccugcagaccggcgacgaggccgacuacuacugcaccaucuggggcgugagaaagggcgugggcgccguguucggcaccggcaccaaggugaucgugcug

SEQ ID NO: 32924 - RNA, 324 nt, Artificial Sequence
  derived and/or modified sequence opt4 from anti-HIV_119-098555_VR-Chain
cagagcgugcugacccagccccccagcgugagcgccgcccccggccagaacgugaccaucagcugcagcggcagcgccagcaacaucggcaagaacuucgugagcugguaccagcagcugcccggcaccgcccccaagcugcugaucuacggcagcaacaacagacccagcggcgugcccgacagauucagcggcagcaagagcggcaccagcgccagccuggccaucaccggccugcagaccggcgacgaggccgacuacuacugcgagaccugggacggcagcggcgccguguucggcaccggcaccaaggugaccgugcug

SEQ ID NO: 32925 - RNA, 324 nt, Artificial Sequence
  derived and/or modified sequence opt4 from anti-HIV_119-097828_VR-Chain
cagagcgugcugacccagccccccagcgugagcgccgcccccggccagaaggugaccaucagcugcagcggcagcagcagcaacaucggcaagaacuacgugagcugguaccagcugcugcccggcaccgcccccagacuggugaucuacgagaacgacgagagacccagcggcacccccgacagauucagcggcagcaagagcggcaccagcgccacccuggccaucaccggccugcacaccggcgacgaggccgacuacuacugcgagaccugggacggcagcggcggcguguucggcaccggcaccaaggugaccgugcug

SEQ ID NO: 32926 - RNA, 324 nt, Artificial Sequence
  derived and/or modified sequence opt4 from anti-HIV_119-096480_VR-Chain
cagagcgugcugacccagccccccagcgugagcggcgcccccggccagagaaucaccaucagcugcagcggcagcaccagcaacaucggccagaacuacgugagcugguaccagcagcugcccggcaccgcccccaagcugcugaucagcgacaacaacagaagacccagcuggacccccgacagauucagcggcagcaagagcggcaccagcgccacccuggccaucaccggccugcagaccggcgacgaggccgacuacuacugcgagaccugggacggcagcggcggcguguucggccccggcaccagagugaccgugcug

SEQ ID NO: 32927 - RNA, 324 nt, Artificial Sequence
  derived and/or modified sequence opt4 from anti-HIV_119-095664_VR-Chain
cagagcgugcugacccagccccccagcgugagcgccgcccccggccagaaggugaccaucagcugcagcggcggcgccgccaacaucggcaagaacagcgugagcugguaccagcagcugcccggcaccgcccccaagcugcugaucuacgacaacaacagaagacccagcggcacccccgacagauucagcggcagcaagagcggcaccagcgccacccuggccaucagcggccugcagaccggcgacgaggccgacuacuacugcgagaccuggcacggcagcggcggcguguucggcaccggcaccaaggugaccgugcug

SEQ ID NO: 32928 - RNA, 321 nt, Artificial Sequence
  derived and/or modified sequence opt4 from anti-HIV_119-095212_VR-Chain
cagagcgugcugacccagccccccagcgugagcgccgcccccggccagaaggugaccaucagcugcagcggcagcaccagcaacaucggcaagagcgacguguucugguaccagcagcugcccggcaccgcccccaagcugcugaucagcgagaccagcagaagacccagcggcauccccgacagauucagcggcgccaagagcggcaccagcgccacccuggccaucaccggccugcagaccggcgacgaggccgacuacuucugcagcaccuggagcggcagccugaacuucggcaccggcaccagagugaccgugcug

SEQ ID NO: 32929 - RNA, 333 nt, Artificial Sequence
  derived and/or modified sequence opt4 from anti-HIV_119-094773_VR-Chain
cagagcgugcugacccagagccccaccgugagcgccgcccccggccagaccgugaccaucagcugcagcggcggcaccagcaacgugggcaagaacuucgugagcugguaccagcaguuccccagaaccgcccccaagcugcugaucuacgagaacaacaagagacccagcggcauccccgacagauucagcggcagcaagagcggcaccagcgccacccuggugaucaccggccugcagaccggcgacgaggccgacuucuacugcggcaccugggacggcagccugagaaccggcggcgugaucggcaccggcaccagagugaccgugcug

SEQ ID NO: 32930 - RNA, 324 nt, Artificial Sequence
  derived and/or modified sequence opt4 from anti-HIV_119-094508_VR-Chain
cagagcgugcugacccagccccccagcgugagcgccacccccggccagagagugaccgugagcugcagcggcagcagcagcaacaucggcaaccacuacgugagcugguaccagcaggugcccggcaccgcccccaagcugcugaucagcgagaacagcagaagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 32931 - RNA, 324 nt, Artificial Sequence
  derived and/or modified sequence opt4 from anti-HIV_119-093795_VR-Chain
cagagcgugcugacccagccccccagcgugagcgccgcccccggccagaaggugaccaucagcugcagcggcagcagcagcaacaucggcaacaacuacgugagcugguaccaguaccugcccggcaccgcccccaagcugcugaucagcgagaacaacagaagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 32932 - RNA, 321 nt, Artificial Sequence
  derived and/or modified sequence opt4 from anti-HIV_119-093732_VR-Chain
cagagcgugcugacccagccccccagcgugagcgccgccgccggccagaacgugaacaucagcugcagcggcagaaagagcaacgugggcggcaacuacgugagcugguaccagcaguuccccggcaccgcccccaagcugcugaucuacgaggacaacaagagacccagcuggauccccgacagauucaccgccagcagaagcggcaccagcgccacccugggcaucaccggccugcagaccggcgacgaggccgacuacuucugcagcaccuggagcggcagccugaacuucggcaccggcaccagagugaccgugcug

SEQ ID NO: 32933 - RNA, 333 nt, Artificial Sequence
  derived and/or modified sequence opt4 from anti-HIV_119-092903_VR-Chain
cagagcgugcugacccagccccccagcgugagcgccgcccccagacagaaggugaccaucagcugcagcggcagcagcagcaacaucggcaaccacuacgugagcugguaccagcagcugcccggcaccgcccccaagcugcugaucuacgagaacaacaagagacccagcggcauccccgacagauucagcggcagcaagagcggcaccagcgccacccuggccaucaccggccugcagaccggcgacgaggccgacuacuacugcgccaccugggcccccagacugaacagcgccagaguguucggcaacggcaccauggugaccgugcug

SEQ ID NO: 32934 - RNA, 333 nt, Artificial Sequence
  derived and/or modified sequence opt4 from anti-HIV_119-092284_VR-Chain
cagagcgugcugacccagccccccagcgugagcggcgcccccggccagagagugaccaucagcugcaccggcagcagcagcaacaucggcggcuacgacgugcacugguaccagcaggugcccggcaccgcccccaagcugcugcuguacgagaacgacagaagacccagcggcauccccgacagauucagcggcagcaagagcggcaccagcgccacccuggugaucaccggccugcagaccggcgacgaggccgacuucuacugcggcaccugggacggcagccugagaaccggcggcgugaucggcaccggcaccagagugaccgugcug

SEQ ID NO: 32935 - RNA, 333 nt, Artificial Sequence
  derived and/or modified sequence opt4 from anti-HIV_119-091586_VR-Chain
cagagcgugcugacccagccccccagcaugagcgccgcccccggccagagagugaccaucagcugcagcggcaccagcagcgacaucggcagaaacuacgugagcugguaccagcaguuccccggcgccgcccccaaggugcugaucuacgagaacagcaacagacccagcggcauccccgacagauucagcggcagcaagagcggcaccagcgccacccuggccaucagcggccugcagaccggcgacgaggccgacuacugcugcgccguguggggcgugagaagaggcgccggcgccguguucggcgccggcaccaaggugaccgugcug

SEQ ID NO: 32936 - RNA, 333 nt, Artificial Sequence
  derived and/or modified sequence opt4 from anti-HIV_119-091023_VR-Chain
cagagcgugcugacccagccccccagcgugagcgccgcccccggccagagagugaccaucagcugcagcggcagcaccagcaacaucggcaacaacuucgugagcugguaccaccacgugcccggcaccgcccccaagcugcugaucuacgacaacgugaagagacccaccaacgugcccgacagauucagcggcagcaagagcggcaccagcgccacccuggccaucagcggccugcagaccggcgacgaggccgacuacuggugcgccguguggggcgugagaagaggcgccggcgccguguucggcgccggcaccaaggugaccgugcug

SEQ ID NO: 32937 - RNA, 333 nt, Artificial Sequence
  derived and/or modified sequence opt4 from anti-HIV_119-090334_VR-Chain
cagagcgugcugacccagccccccagcgugagcggcgcccccggccagagagugaccaucagcugcaccggcagcgccagcaacaucggcgacagcgacgugcacugguaccagcagcugcccggcaccgcccccaagcugcugaucuucgacaacgacaagagacccagcggcauccccgacagauucagcggcagcaagagcggcaccagcgccacccuggccaucaccggccugcagagcggcgacgaggccgacuacuacugcgccguguggggcgugagacagggcgccggcgccguguucggcaccggcaccaaggugaccgugcug

SEQ ID NO: 32938 - RNA, 333 nt, Artificial Sequence
  derived and/or modified sequence opt4 from anti-HIV_119-088694_VR-Chain
cagagcgugcugacccagccccccagcgugagcgccgcccccggccagaaggugaccaucagcugcagcggcagcagcagcaacauccccaucaacggcgugagcugguaccagcaguuccccggcaccgcccccaagcugcugguguacgagaccuacagaagacccagcggcauccccgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 32939 - RNA, 333 nt, Artificial Sequence
  derived and/or modified sequence opt4 from anti-HIV_119-088499_VR-Chain
cagagcgugcugacccagccccccagcgugagcgccgcccccggccagaaggugaccaucagcugcagcggcagcaacagcuacaucggcaacaaguacgugagcugguaccagcaguuccccggcaccgcccccaagcugcugaucuacgagaccaacaagagacccagcggcauccccgacagauucagcggcagcaagagcggcaccagcgccacccuggccaucaccggccugcagaccggcgacgaggccgacuacuacugcgccaccugggcccccagacugaacagcgccagaguguucggcaacggcaccauggugaccgugcug

SEQ ID NO: 32940 - RNA, 333 nt, Artificial Sequence
  derived and/or modified sequence opt4 from anti-HIV_119-088298_VR-Chain
cagagcgugcugacccagccccccagcgugagcgccgcccccaaggagaaggugaccaucagcugcagcggcggcaccagcaacaucggcagaaacuacgugagcugguaccagcaggugcccggcaccgcccccaagcugcugaucuacgagaacaacaagagacccagcggcauccccgacagauucagcggcagcaagagcggcaccagcgccacccuggugaucaccggccugcagaccggcgacgaggccgacuucuacugcggcaccuggggcggcagccugagaaccggcggcgugcugggcaccggcaccagagugaccgugcug

SEQ ID NO: 32941 - RNA, 324 nt, Artificial Sequence
  derived and/or modified sequence opt4 from anti-HIV_119-087488_VR-Chain
cagagcgugcugacccagccccccagcgugagcgccgcccccggccagaaggugaccaucuucugcagcggcagauacagcaacaucgagagcaacuacgugagcugguaccagcagcugcccggcaccgcccccaagcugcugauccacgagaacaacagaagacccagcggcacccccgacagauucagcggcagcaagagcggcaccagcgccacccuggccaucaccggccugcacaccggcgacgaggccgacuacuacugcgagaccugggacggcagcggcggcguguucggcaccggcaccaaggugaccgugcug

SEQ ID NO: 32942 - RNA, 333 nt, Artificial Sequence
  derived and/or modified sequence opt4 from anti-HIV_119-087423_VR-Chain
cagagcgugcugacccagccccccagcgugagcgccgcccccggccagaaggugaccaucagcugcagcgccagcagcagcaacaucggcaacaacuacgugagcugguaccagcagcugcccgccaccgcccccaagcugcugaucuacgacaccgacaagagacccagcggcauccccgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 32943 - RNA, 324 nt, Artificial Sequence
  derived and/or modified sequence opt4 from anti-HIV_119-087371_VR-Chain
cagagcgugcugacccagccccccagccugagcgccgcccccggccagagagugaccaucagcugcagcggcggcgccagcaacaucggcaagaacagcgugagcugguacgugcaggugcccggcaccgcccccaagcugcugaucuacgagaacaaccagagacccagcggcaucagcgacagauucagcggcagcaagagcggcagcagcgccacccugggcaucaccggccugcagaccgccgacgaggccgacuacuacugcgagaccugggacggcagcggcggcguguucggcaccggcaccaaggugaccgugcug

SEQ ID NO: 32944 - RNA, 321 nt, Artificial Sequence
  derived and/or modified sequence opt4 from anti-HIV_119-087279_VR-Chain
cagagcgugcugacccagccccccagcgugagcgccgcccccggccagaaggugaccaucagcugcagcggcagcagcagcaacaucggcaagaacuacgugagcugguaccagcaguuccccggcaccgcccccaagcugcugauguacgagaacaacaagagacccagcggcgugcccgacagauucagcggcagcaagagcggcaccagcgccacccuggacaucagcggccugcagaccggcgacgaggccgacuacuacugcagcaccuggagcggcagccugaacuucggcaccggcaccagagugaccgugcug

SEQ ID NO: 32945 - RNA, 324 nt, Artificial Sequence
  derived and/or modified sequence opt4 from anti-HIV_119-087146_VR-Chain
cagagcgugcugacccagccccccagcgugagcgccgcccccggccagaaggugaccaucagcugcagcggcagcagcagcaacaucggcaagaacagcgugagcugguaccagcaguuccccggcaccgcccccaagcugcugaucuacgagaacaacaagagacccagcggcauccccgacagauucagcggcagcaagagcggcaccagcgccacccuggccaucaccggccugcacaccggcgacgaggccgacuacuacugcgagaccugggacggcagcggcggcguguucggcaccggcaccaaggugaccgugcug

SEQ ID NO: 32946 - RNA, 324 nt, Artificial Sequence
  derived and/or modified sequence opt4 from anti-HIV_119-087048_VR-Chain
caguucgugcugacccagccccccagcgugagcgccgcccccagacagaaggugaucaucagcugcagcggcagcagcagcaacaucggcaagaacuacgugagcugguaccagcagcugcccggcaccgcccccaagcugcugaucuacgacaacgacaagagacccagcggcaucagcgacagauucagcgccagcaagagcggcaccagcgccacccuggccaucaccggccugcacaccggcgacgaggccgacuacuacugcgagaccugggacggcagcggcggcguguucggcaccggcaccaaggugaccgugcug

SEQ ID NO: 32947 - RNA, 321 nt, Artificial Sequence
  derived and/or modified sequence opt4 from anti-HIV_119-085802_VR-Chain
cagagcauccugacccagccccccagcgugagcgccgcccccggccagagagugaccauccccugcuucggcggccacagcaacaucggcagcaacuacgugagcugguaccagcaccugcccggcaccgcccccaagcugcugaucuucgagaacaacaagagacccagcggcauccccgacagauucagcggcgccaagagcggcaccagcgccacccuggccaucaccggccugcagaccggcgacgaggccgacuacuucugcgccaccuggagcggcggccugaacuucggcaccggcaccaaggugaccgugcug

SEQ ID NO: 32948 - RNA, 324 nt, Artificial Sequence
  derived and/or modified sequence opt4 from anti-HIV_119-085784_VR-Chain
cagagcuuccugacccagccccccagcgugagcgccgcccccggccagaaggugaccaucagcugcagcggcagcaacagcaacaucggcaacaacuacgugagcugguaccaguaccugcccggcaccgcccccaagcugcugaucuacgagaacgacagaagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 32949 - RNA, 333 nt, Artificial Sequence
  derived and/or modified sequence opt4 from anti-HIV_119-085370_VR-Chain
cagagcgugcugacccagccccccagcgugagcgccgcccccggccagaccgugaccaucagcugcagcggcagcagcagcaacaucggcaacaccuacgugagcugguaccagcaccugcccggcaccgcccccaagcugcugaucuacgacaacaacaucagacccagcggcauccccgacagauucagcgccagcaagagcggcaccagcgccacccuggccaucaccggccugcagaccggcgacgaggccgacuacuacugcgccaccugggcccccagccugaacagcgccagaguguucggcagcggcaccagaguggccgugcug

SEQ ID NO: 32950 - RNA, 321 nt, Artificial Sequence
  derived and/or modified sequence opt4 from anti-HIV_119-085276_VR-Chain
cagagcauccugacccagccccccagcgugagcgccgcccccggccagagagugaccaucagcugcagcggcagcagcagcaacaucggcaacaacuacgugagcugguaccagcacgugcccggcaccgcccccaagcugcugaucuacgagaacaacagaagacccagcggcacccccgacagauucagcggcgccaagagcggcaccagcgccacccuggccaucaccggccugcagaccggcgacgaggccgacuacuucugcagcaccuggagcggcagccugaacuucggcaccggcaccaaggugaccgugcug

SEQ ID NO: 32951 - RNA, 333 nt, Artificial Sequence
  derived and/or modified sequence opt4 from anti-HIV_119-084885_VR-Chain
cagagcgugcugacccagccccccagcgugagcgccgcccccggcgagaaggugaccaucagcugcagcggcagcagcagcaagaucggcaacaacuucgugagcugguaccagcaggugcccggcaccgcccccaagcugcugguguacgagagcuacagaagacccagcggcauccccgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 32952 - RNA, 333 nt, Artificial Sequence
  derived and/or modified sequence opt4 from anti-HIV_119-084874_VR-Chain
cagagcgugcugacccagccccccagcgugagcggcgcccccagacagagagugaccaucagcugcagcggcagcgccagcaacaucggcaagaacagcgugagcugguaccagcaggugcccggcaccgcccccaagcugcugaucuacgagaacaacaagagacccagcggcauccccgacagauucagcggcagcaagagcggcaccagcgccacccuggugaucaccggccugcagaccggcgacgaggccgacuucuacugcggcaccugggacggcagccugagaaccggcggcgugaucggcaccggcaccagagugaccgugcug

SEQ ID NO: 32953 - RNA, 333 nt, Artificial Sequence
  derived and/or modified sequence opt4 from anti-HIV_119-084691_VR-Chain
cagagcgugcugacccagccccccagcgugagcgccgcccccggccagaagguggugaucagcugcagcggcagcagcagcaucaucgagaagaacagcaucagcugguaccagcagggccccggcgccgcccccaagcugcugaucuacgagaacgacaagagacccagcggcauccccgacagauucagcggcagcaagagcgccaccagcgccacccuggccaucgugggccugcagaccggcgacgaggccgacuacugcugcgccguguggggcgugagaagaggcgccggcgccguguucggcgccggcaccaaggugaccgugcug

SEQ ID NO: 32954 - RNA, 324 nt, Artificial Sequence
  derived and/or modified sequence opt4 from anti-HIV_119-083793_VR-Chain
cagagcgugcugacccagccccccagcgugagcgccgcccccggccagaaggugaccaucagcugcagcggcagcagcagcaacaucggcaagaacagcgugagcugguaccagcagcugcccgccaccgcccccaagcugcugaucuacgagagcaacaagagacccagcggcauccccgacagauucagcggcagcaagagcggcaccagcgccacccuggccaucaccggccugcagaccggcgacgaggccgacuacuacugcgccaccugggacggcagagugagcgugaucggcaccggcaccaaggugaccgugcug

SEQ ID NO: 32955 - RNA, 324 nt, Artificial Sequence
  derived and/or modified sequence opt4 from anti-HIV_119-083163_VR-Chain
cagagcgugcugacccagccccccagcgugagcggcgcccccggccagagagugaucaucagcugcaccggcagcagcagcaacaucuggggcuacgacgugcagugguaccagcagcugcccggcaccgcccccaagcugcugcuguacgagaacgacagaagacccagcggcacccccgacagauucagcggcagcaagagcggcaccagcgccacccuggccaucaccggccugcacaccggcgacgaggccgacuacuacugcgagaccugggacggcagcggcggcguguucggcaccggcaccaaggugaccgugcug

SEQ ID NO: 32956 - RNA, 333 nt, Artificial Sequence
  derived and/or modified sequence opt4 from anti-HIV_119-082331_VR-Chain
cagagcgugcugacccagccccccagcaucagcgccgcccccggccagaaggugaccaucagcugcagcggcggcagcagcaacaucggcgccaacuacgugagcugguaccagcaccugcccggcaccgcccccaagcugcugaucuacgagaccaacaagagacccagcggcauccccgacagauucagcggcagccagagcggcaccagcgccacccuggugaucaccggccugcagaccggcgacgaggccgacuucuacugcggcaccuggggcggcagccugagagccggcggcgugaucggcaccggcaccagagugaccgugcug

SEQ ID NO: 32957 - RNA, 324 nt, Artificial Sequence
  derived and/or modified sequence opt4 from anti-HIV_119-082070_VR-Chain
cagagcgugcugacccagccccccagcgugagcgccgcccccggccagaagguggugaucagcugcagcggcagcagcagcaucaucgagaagaacagcaucagcugguaccagcagggccccggcgccgcccccaagcugcugaucuacgagaacgacagaagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 32958 - RNA, 333 nt, Artificial Sequence
  derived and/or modified sequence opt4 from anti-HIV_119-081512_VR-Chain
cagagcgugcugacccagccccccagcgugagcgccgcccccggccagaacgugaccuucagcugcagcggcagcaacagcaacaucggcgacaacuacgugagcugguaccagcagauccccggcaccgcccccaagcuggugaucuacgacaacaacaagagacccagcggcauccccgacagauucagcggcagcaagagcggcaccagcgccacccuggugaucaccggccugcagaccggcgacgaggccgacuucuacugcggcaccugggacggcagccugagaaccggcggcgugaucggcaccggcaccagagugaccgugcug

SEQ ID NO: 32959 - RNA, 333 nt, Artificial Sequence
  derived and/or modified sequence opt4 from anti-HIV_119-080816_VR-Chain
cagcuggugcugacccagccccccagcgccagcggcacccccggccagagagugaccaucagcugcagcggcagcagcagcaacaucggcagcaacuucgugagcugguaccagcagagacccggcaccgcccccaagcugcugaucuacgagaccaacaagagacccagcggcauccccgacagauucagcggcagcaagagcggcaccagcgccacccuggccaucaccggccugcagaccggcgacgaggccgacuacuacugcgccaccugggcccccagacugaacagcgccagaguguucggcaacggcaccauggugaccgugcug

SEQ ID NO: 32960 - RNA, 333 nt, Artificial Sequence
  derived and/or modified sequence opt4 from anti-HIV_119-079302_VR-Chain
cagagcgugcugacccagccccccagcgugagcgccgcccccggccagaaggugaccaucagcugcagcggcagcagcagcuacaucggcaacaaguacgugagcugguaccagcaguuccccggcaccgcccccaagcugcugaucuacgagaacaacaagagacugagcggcauccccgacagauucagcgccagcaagagcgccaccagcgccacccuggccaucagcggccugcagaccggcgacgaggccgacuucuacugcggcaccugggacggcagccugagaaccggcggcgugaucggcaccggcaccagagugaccgugcug

SEQ ID NO: 32961 - RNA, 327 nt, Artificial Sequence
  derived and/or modified sequence opt4 from anti-HIV_119-079292_VR-Chain
cagagcgugcugacccagccccccagcgugagcgccgcccccggccagaaggugaccaucagcugcagcggcagcaacagcaacaucggcaacaacuacgugagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccaacuacuacugcggcaccugggacaccagccugagcggcguguucggcaccggcaccgaggugaucgugcug

SEQ ID NO: 32962 - RNA, 321 nt, Artificial Sequence
  derived and/or modified sequence opt4 from anti-HIV_119-079289_VR-Chain
cagagcgcccugacccagccccccagcgugagcgccgcccccggccagagagugaccaucagcugcagcggcaacaacagcaacaucggcaacaacuucgugagcugguaccagcugcugcccggcaccgcccccaagcugcugaucuacgagaacaacaagagaagcagcggcauccccgacagauucagcggcagcaagagcggcaccagcgccacccugggcaucaccggccugcagaccggcgacgaggccgacuacuucugcagcaccuggagcggcagccugaacuucggcaccggcaccagagugaccgugcug

SEQ ID NO: 32963 - RNA, 324 nt, Artificial Sequence
  derived and/or modified sequence opt4 from anti-HIV_119-078935_VR-Chain
cagagcgugcugacccagccccccagcgugagcgccgcccccggccagagagugaccaucagcugcagcggcaccagcgccaacaucgagaacuacuacgugagcugguaccagcagcugcccggcaccgcccccaagcugaucaucuacgacgacaacaagagacccagcggcaucccccagagauucagcggcagcaagagcggcaccagcgccacccugggcaucaccggccugcagaccggcgacgaggccgaguacuacugcgagaccugggacggcagcggcggcguguucggcaccggcaccaaggugaccgugcug

SEQ ID NO: 32964 - RNA, 324 nt, Artificial Sequence
  derived and/or modified sequence opt4 from anti-HIV_119-078702_VR-Chain
cagagcgugcugacccagccccccagcgugagcgccgcccccggccagaaggugaccaucagcugcagcggcagcagcagcguguucggcaagaacuacgugagcugguaccagcaccugcccggcaccgcccccaagcugcugaucuacgagaacaccaagagacccagcggcauccccgacagauucagcggcagcaagagcggcaccagcgccacccuggccaucaccggccugcagaccggcgacgaggccgacuacuacugcgagaccugggacggcagcggcggcguguucggcagcggcaccaaggugaccgugcug

SEQ ID NO: 32965 - RNA, 324 nt, Artificial Sequence
  derived and/or modified sequence opt4 from anti-HIV_119-078593_VR-Chain
cagagcuuccugacccagccccccagcgugagcgccgcccccggccagaaggugaccaucagcugcagcggcagcaacagcaacaucggcaacaacuacgugagcugguaccagcaggugcccggcaccgcccccaagcugcugaucuacgagaacaacaagagacccagcggcauccccgacagauucagcggcagcaagagcggcaccagcgccacccuggugaucaccggccugcacaccggcgacgaggccgacuacuacugcgagaccugggacggcagcggcggcguguucggcaccggcagcaacgugacccugcug

SEQ ID NO: 32966 - RNA, 333 nt, Artificial Sequence
  derived and/or modified sequence opt4 from anti-HIV_119-077708_VR-Chain
cagagcgugcugacccagccccccagccugagcgccgcccccggccagaaggugaccaucagcugcagcggcaccaccagcaacaucggcaacaacuacgugagcugguaccagcaccugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcaccguguggggcgugagaaagggcgugggcgccguguucggcaccggcaccaaggugaccgugcug

SEQ ID NO: 32967 - RNA, 321 nt, Artificial Sequence
  derived and/or modified sequence opt4 from anti-HIV_119-076904_VR-Chain
cagagcgugcugacccagccccccagcgugagcgccgcccccggccagaaggugaccaucagcugcagcagaagcagcagccacaucgagaacagcuacgugagcugguaccagcaccugcccggcaccgcccccaagcugcugaucuacgagaacaacaagagacccagcggcauccccgacagauucagcggcagcaagagcggcaccagcgccacccugggcaucagcggccugcagaccggcgacgaggccgacuacuucugcagcaccuggagcggcagccugaacuucggcaccggcaccagagugaccgugcug

SEQ ID NO: 32968 - RNA, 324 nt, Artificial Sequence
  derived and/or modified sequence opt4 from anti-HIV_119-075862_VR-Chain
cagagcgugcugacccagccccccagcaucagcgccgcccccggccagaaggugaccaucagcugcagcggcagcgccagcaacaucggcaagaacagcgugagcugguaccagcaguuccccggcaccgcccccaagcugcugaucuacgagaacaacagaagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 32969 - RNA, 333 nt, Artificial Sequence
  derived and/or modified sequence opt4 from anti-HIV_119-075465_VR-Chain
cagagcgugcugacccagccccccagcgugagcgccgcccccggccagaagguggugaucagcugcagcggcagcagcagcaucaucggcaacaacuacgugagcugguaccagcagcugcccggcaccgcccccaagcugcugaucuacgagaacaacagaagacccagcggcauccccgacagauucagcggcagcaagagcggcaccagcgccacccuggccaucagcggccugcagaccggcgacgaggccgacuacugcugcgccguguggggcgugagaagaggcgccggcgccguguucggcgccggcaccaaggugaccgugcug

SEQ ID NO: 32970 - RNA, 330 nt, Artificial Sequence
  derived and/or modified sequence opt4 from anti-HIV_119-074822_VR-Chain
agcgugcugacccagccccccagcgugagcgccgcccccggccagaacaucaccaucagcugcagcggcggcagcagcaacaucgccaagaacuacaucagcugguaccagcaccugcccggcaccgcccccaagaucgugaucuacgacaacgacaagagaccccugggcauccccgacagauucagcgccagcaagagcggcaccagcgccacccugggcaucaccggccugcagaccggcgacgaggccgacuacuacugcgccguguggggcgugagaagaggcgugggcgccguguucggcgccggcaccaaggugaucgugcug

SEQ ID NO: 32971 - RNA, 333 nt, Artificial Sequence
  derived and/or modified sequence opt4 from anti-HIV_119-074629_VR-Chain
cagagcgugcugacccagccccccagcgagagcgccgcccccggccagaaggugaccaucagcugcagcggcggcaccagcaacaucggcaacaacuacgugagcugguacagaagacugcccggcaccgcccccaagcugcugaucuacgagaacaacagaagacccagcggcauccccgacagauucagcggcagcaagagcggcaccagcgccacccuggccaucagcggccugcagaccggcgacgaggccgacuacugcugcgccguguggggcgugagaagaggcgccggcgccguguucggcgccggcaccaaggugaccgugcug

SEQ ID NO: 32972 - RNA, 324 nt, Artificial Sequence
  derived and/or modified sequence opt4 from anti-HIV_119-074500_VR-Chain
cagagcgugcugacccagccccccagcgugagcgccgcccccggccagaaggugaccaugagcugcagcggcagcagcagcaacaucggcaacaacuacgugagcugguaccaguaccugcccggcaccgcccccaagcugcugaucuacgagaacgacagaagacccagcggcauccccgacagauucagcgccagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 32973 - RNA, 333 nt, Artificial Sequence
  derived and/or modified sequence opt4 from anti-HIV_119-073911_VR-Chain
cagagcgugcugacccagccccccagcgugagcgccgcccccggccagagagugaccaucagcugcagcggcagcagcagcaacaucgagaacaacuacgugagcugguaccagcaccugcccggcaccgcccccaagcugcugguguacgacgacaacaagagacccagcggcaucccccacagauucagcgccagcaagagcggcaccagcgccacccuggccaucaccggccugcagaccggcgacgaggccgacuacuacugcacccuguggggcgugagaaagggcgugggcgccguguucggcaccggcaccaaggugaccgugcug

SEQ ID NO: 32974 - RNA, 324 nt, Artificial Sequence
  derived and/or modified sequence opt4 from anti-HIV_119-072765_VR-Chain
cagagcgugcugacccagccccccagcgugagcgccgcccccggccagaaggugaccaucagcugcagcggcaacagcagcaacaucggcaacaacuucgugagcugguaccagcaggugcccggcaccgcccccaagcugcugguguacgagaccuacagaagacccagcggcacccccgacagauucagcggcagcaagagcggcaccagcgccacccuggccaucagcggccugcagaccggcgacgaggccgacuacuacugcggcaccugggacggcagcggcggcguguucggcaccggcaccaaggugaccgugcug

SEQ ID NO: 32975 - RNA, 333 nt, Artificial Sequence
  derived and/or modified sequence opt4 from anti-HIV_119-072313_VR-Chain
caguucgugcugacccagccccccagcgugagcgccgcccccggccagaaggugaccaucagcugcagcgccagcagcagcaucaucggcaagaacuacgugagcugguaccagcaguuccccggcaccgcccccaagcugcugaucuacgaggacaacaagagacccagcggcauccccgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 32976 - RNA, 333 nt, Artificial Sequence
  derived and/or modified sequence opt4 from anti-HIV_119-072280_VR-Chain
cagagcgugcugacccagccccccagcgugagcgccgcccccggccagaaggugagcaucagcugcagcggcagcgacagcaaccugggcgacaacuacgugagcugguaccagcaguuccccggcaccgcccccaagcugcugauccacgacaacaacaagagacccagcggcacccccgacagauucagcggcagcaagagcggcaccagcgccacccuggccaucaccggccugcagaccggcgacgaggccgacuacuacugcgccaccugggcccccagacugaacagcgccagaguguucggcaacggcaccauggugaccgugcug

SEQ ID NO: 32977 - RNA, 333 nt, Artificial Sequence
  derived and/or modified sequence opt4 from anti-HIV_119-071693_VR-Chain
cagagcgugcugacccagccccccagcgugagcgccgcccccggccagaagguggugaucagcugcagcggcagcagcagcaucaucgagaagaacagcaucagcugguaccagcagggccccggcgccgcccccaagcugcugaucuacgagaacgacaagagacccagcggcauccccgacagauucagcggcagcaagagcggcaccagcgccacccuggccaucaccggccugcagaccggcgacgaggccgacuacuacugcaccaucuggggcgugagaaagggcgugggcgccguguucggcaccggcaccaaggugaccgugcug

SEQ ID NO: 32978 - RNA, 321 nt, Artificial Sequence
  derived and/or modified sequence opt4 from anti-HIV_119-071353_VR-Chain
cagagcgugcugacccagccccccagcgccagcgccgcccccggccagaaggugaccaucagcugcagcggcagcaacagcaacaucggcaacaacuucgugagcugguaccagcuguuccccggcaccgcccccaagcugcugaucuucgagaacaacaagagacccagcggcauccccgacagauucagcggcgccaagagcggcaccagcgccacccuggccaucaccggccugcagaccggcgacgaggccgacuacuucugcagcaccuggagcggcagccugaacuucggcaccggcaccagagugaccgugcug

SEQ ID NO: 32979 - RNA, 324 nt, Artificial Sequence
  derived and/or modified sequence opt4 from anti-HIV_119-069711_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgacaacaacaacagacccagcggcgugcccgacagauucagcggcagcaagagcggcaccagcgccacccuggccaucaccggccugcagaccggcgacgaggccgacuacuacugcgagaccugggacgacagcggcggcguguucggcaccggcaccaaggugaccgugcug

SEQ ID NO: 32980 - RNA, 333 nt, Artificial Sequence
  derived and/or modified sequence opt4 from anti-HIV_119-069061_VR-Chain
cagagcgugcugacccagccccccagcgugagcgccgcccccggccagaaggugaccaucagcugcagcggcagcagcagcaacaucggcagcaacuacgugagcugguaccagcagcugcccggcaccgcccccaagcugcugguguacgacaacaacgagagacccagcggcauccccgacagauucagcggcagcaagagcggcaccagcgccacccuggccaucaccggccugcagaccggcgacgaggccgacuacuacugcgccaccugggcccccagacugaacagcgccagaguguucggcaacggcaccauggugaccgugcug

SEQ ID NO: 32981 - RNA, 324 nt, Artificial Sequence
  derived and/or modified sequence opt4 from anti-HIV_119-068202_VR-Chain
cagagcgugcugacccaggagcccagcgugagcggcgcccccggccagagagugaccaucagcugcaccggcagcaacagcaacaucggcggccacgacgugcacugguaccagcagcugcccggcaccgcccccaagcugcugaucuacgacaacgacaagagacccagcggcauccccgacagauucagcggcagcaagagcgacaccagcgccagccugggcaucaccggccugcagaccggcgacgaggccgacuacuacugcgagaccugggacggcagcggcggcguguucggcaccggcaccaaggugaccgugcug

SEQ ID NO: 32982 - RNA, 324 nt, Artificial Sequence
  derived and/or modified sequence opt4 from anti-HIV_119-068063_VR-Chain
cagagcgcccugacccagccccccagcgccagcggcagccugggccagagcgugaccaucagcugcaccggcaccagaagcgacgugggcaacuacuacgugagcugguaccagcagcugcccggcaccgcccccaagcugcugaucagcgagaacaacagaagacccagcggcacccccgacagauucagcggcagcaagagcggcaccagcgccacccuggccaucagcggccugcagaccggcgacgaggccgacuacuacugcggcaccugggacggcagcggcggcguguucggcaccggcaccaaggugaccgugcug

SEQ ID NO: 32983 - RNA, 333 nt, Artificial Sequence
  derived and/or modified sequence opt4 from anti-HIV_119-067980_VR-Chain
cagagcgugcugacccagccccccagcgugagcgccgcccccggccagaaggugaccaucagcugcagcggcaacagcagcaacaucggcaacaacuucgugagcugguaccagcaggugcccggcaccgcccccaagcugcugguguacgagaccuacagaagacccagcggcauccccgacagauucagcggcagcaagagcggcaccagcgccacccuggccaucaccggccugcagaccggcgacgaggccgacuaccacugcgccaucuggggcgugagaaagggcgugggcgccguguucggcaccggcaccaaggugaccguggug

SEQ ID NO: 32984 - RNA, 324 nt, Artificial Sequence
  derived and/or modified sequence opt4 from anti-HIV_119-067866_VR-Chain
cagagcgugcugacccagccccccagcgugagcgccgcccccggccagaaggugaccaucagcugcagcggcagcaccagcaccaucggcaacaacuacgugagcugguaccagcaccugcccggcaccgcccccaagcugcugaucuacgacaacaacaagagacccgccggcauccccgacagauucaccgccagcaagagcggcaccagcgccacccuggccaucaccggccugcacaccggcgacgaggccgacuacuacugcgagaccugggacggcagcggcggcguguucggcaccggcaccaaggugaccgugcug

SEQ ID NO: 32985 - RNA, 321 nt, Artificial Sequence
  derived and/or modified sequence opt4 from anti-HIV_119-067756_VR-Chain
cagagcgugcugacccagccccccagcgugagcgccgcccccggccagaagguggugaucagcugcagcggcagcaccagcaacaucggcaagaacuucgugagcugguaccagcagcugcccggcaccgcccccaagcugcugaucuacgagaacagcagaagacccagcggcauccccgacagauucagcggcgccaagagcggcaccagcgccacccuggccaucaccggccugcagaccggcgacgaggccgacuacuucugcagcaccuggagcggcagccugaacuucggcaccggcaccagagugaccgugcug

SEQ ID NO: 32986 - RNA, 321 nt, Artificial Sequence
  derived and/or modified sequence opt4 from anti-HIV_119-066859_VR-Chain
cagagcgugcugacccagccccccagcgugagcgccgcccccggccagaaggugaccaucaccugcagcggcagcgccagcaacaucgagaacaacuacgugagcugguaccagcaguuccccggccccgcccccaagcugcugaucuacgagaacgacaagagacccagcggcauccccgacagauucagcggcagcgccagcggcaccagcgccacccuggccaucaccggccugcagaccggcgacgaggccgacuacuucugcagcaccuggagcggcagccugaacuucggcaccggcaccagagugaccgugcug

SEQ ID NO: 32987 - RNA, 333 nt, Artificial Sequence
  derived and/or modified sequence opt4 from anti-HIV_119-065821_VR-Chain
cagagcgugcugacccagccccccagcgugagcgccacccccggccagagagugaccgugagcugcagcggcagcagcagcaacaucggcaaccacuacgugagcugguaccagcaggugcccggcaccgcccccaagcugcugaucuacgacaacagcaacagacccagcggcauccccgacagauucagcggcagcaagagcggcaccagcgccacccugggcaucaccggccugcagaccggcgacgaggccgacuacuacugcaccguguggggcgugagaaagggcgugggcgccguguucggcaccggcaccaaggugaccgugcug

SEQ ID NO: 32988 - RNA, 333 nt, Artificial Sequence
  derived and/or modified sequence opt4 from anti-HIV_119-065191_VR-Chain
cagagcgugcugacccagccccccagcgugagcgccgcccccggccagaaggugaccaucagcugcagcggcaacaacagcaacaucggcaacaacuacgugagcugguaccagcagcugcccggcaccgcccccaagcugcugaucuucgagaaccacaagagacccagcggcauccccgacagauucagcggcagcaagagcggcaccagcgccacccugggcaucaccggccugcagagcggcgacgaggccgacuacuacugcgccaccugggcccccagacugaacagcgccagaguguucggcaccggcaccaaggugaccgugcug

SEQ ID NO: 32989 - RNA, 333 nt, Artificial Sequence
  derived and/or modified sequence opt4 from anti-HIV_119-064667_VR-Chain
cagagcgugcugacccagccccccagcgugagcgccgcccccggccagaaggugaccaucagcugcagcggcagcaacagcuacaucggcaacaaguacgugagcugguaccagcaggugcccggcaccgcccccaagcugcugaucuacgagaacaacaagagacccagcggcauccccgacagauucagcggcagcaagagcggcaccagcgccacccuggugaucaccggccugcagaccggcgacgaggccgacuucuacugcggcaccugggacggcagccugagaaccggcggcgugaucggcaccggcaccagagugaccgugcug

SEQ ID NO: 32990 - RNA, 324 nt, Artificial Sequence
  derived and/or modified sequence opt4 from anti-HIV_119-063791_VR-Chain
cagagcgugcugacccagccccccagcgugagcgccgcccccggccagaaggugcccaucagcugcagcggcaacagcagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccuggccaucaccggccugcacaccggcgacgaggccgacuacuacugcgagaccugggacggcagcggcggcguguucggcaccggcaccaaggugaccgugcug

SEQ ID NO: 32991 - RNA, 333 nt, Artificial Sequence
  derived and/or modified sequence opt4 from anti-HIV_119-062989_VR-Chain
cagagcgugcugacccagccccccagcgugagcgccgcccccggccagagagugaccaucagcugcagcggcagcagcagcaacaucggcaacaacuucgugagcugguaccagcaguuccccggcaccgugcccaagcugcugaucuacgagaacaacagaagacccagcggcauccccgacagauucagcggcagcaagagcggcaccagcgccacccuggccaucaccggccugcagaccggcgacgaggccgacuacuacugcgccguguggggcgugagaagaggcgugggcgccguguucggcgccggcaccaaggugaucgugcug

SEQ ID NO: 32992 - RNA, 321 nt, Artificial Sequence
  derived and/or modified sequence opt4 from anti-HIV_119-062286_VR-Chain
cagagcgugcugacccagccccccagcgugagcgccgcccccggccagaaggugaccaucagcugcagcggcagcgccagcaacaucggcaagaacuucgugagcugguaccagcagcugcccggcaccgcccccaagcugcugaucagcgagaacaacagaagacccagcggcacccccgacagauucagcggcagcaagagcggcgccagcgccacccuggugaucagcggccugcagaccggcgacgaggccgacuacuacugcgccaccuggagcggcagccugagcaucggcaccggcaccaaggugaccgugcug

SEQ ID NO: 32993 - RNA, 321 nt, Artificial Sequence
  derived and/or modified sequence opt4 from anti-HIV_119-061416_VR-Chain
cagagcgugcugacccagccccccagcgugagcgccgcccccggccagaagguggugaucagcugcagcggcagcagcagcaucuucgagaagaacagcaucagcugguaccagcagggccccggcgccgcccccaagcugcugaucuacgagaacgacaagagaagaagcggcauccccgacagauucagcggcagcaagagcgccaccagcaccacccuggccaucgugggccugcagaccggcgacgaggccgacuacuucugcagcaccuggagcggcagccugaacuucggcaccggcaccagagugaccgugcug

SEQ ID NO: 32994 - RNA, 321 nt, Artificial Sequence
  derived and/or modified sequence opt4 from anti-HIV_119-061344_VR-Chain
cagagcgugcugacccagccccccagcgugagcgccgcccccggccagaaggugaccaucagcugcagcggcagcagcagcguguucggcaagaacuacgugagcugguaccagcaccugcccggcaccgcccccaagcugcugaucuacgagaacaacaagagacccagcggcauccccgacagauucagcggcgccaagagcggcaccgccgccacccuggccaucaccggccugcagaccggcgacgaggccgacuacuacugcgccaccuggagcggcagccugaacuucggcaccggcaccaaggugaccgugcug

SEQ ID NO: 32995 - RNA, 324 nt, Artificial Sequence
  derived and/or modified sequence opt4 from anti-HIV_119-060240_VR-Chain
cagagcgugcugacccagccccccagcgaguacggcgcccccggccacaacgugaccgugagcugcagcggcaccaccagcaacaucgagaacaacuucgugagcugguaccugaucgugcccggcaccgcccccaagcugcugaucuucgacaacgacaagagacccagcggcauccccgacagauucagcggcagcaagagcggcaccagcgccacccuggccaucaccggccugcagaccggcgacgaggccgacuacuacugcgccaccugggacggcagagugagcgugaucggcaccggcaccaaggugaccgugcug

SEQ ID NO: 32996 - RNA, 333 nt, Artificial Sequence
  derived and/or modified sequence opt4 from anti-HIV_119-060184_VR-Chain
cagagcgugcugacccagccccccagcgugagcggcgcccccggccagagagugaccaucagcugcagcggcagcagcagcaacaucggcagcaacaccgugaacugguaccagcagcugcccggcaccgcccccaagcugcugaucuacgacaacaacaagagacccagcggcauccccgacagauucagcggcagcaagagcggcaccagcgccacccuggugaucaccggccugcagaccggcgacgaggccgacuucuacugcggcaccugggacggcagccugagaaccggcggcgugaucggcaccggcaccagagugaccgugcug

SEQ ID NO: 32997 - RNA, 321 nt, Artificial Sequence
  derived and/or modified sequence opt4 from anti-HIV_119-058035_VR-Chain
cagagcgugcugacccagccccccagcgugagcgccgcccccggccagaaggugaccaucagcugcagcggcagcgccagcaacaucggcaagaacuucgugagcugguaccagcagcugcccggcaccgcccccaagcugcugaucuacgagaacaacagaagacccagcggcacccccgacagauucagcggcgccaagagcggcaccagcgccacccuggccaucaccggccugcagaccggcgacgaggccgacuacuucugcagcaccuggagcggcagccugaacuucggcaccggcaccagagugaccgugcug

SEQ ID NO: 32998 - RNA, 321 nt, Artificial Sequence
  derived and/or modified sequence opt4 from anti-HIV_119-057858_VR-Chain
cagagcgugcugacccagccccccagcgugagcgccgcccccggccagaacgugaacaucagcugcagcggcggcagcagcaacaucggcagcaacuacgugagcugguaccagcaguuccccggcaccgcccccaagcugcugaucuacgagaacaacaagagacccagcggcauccccgacagauucagcggcgccaagagcggcaccagcgccacccuggccaucaccggccugcagaccggcgacgaggccgacuacuucugcagcaccuggagcggcagccugaacuucggcaccggcaccagagugaccgugcug

SEQ ID NO: 32999 - RNA, 324 nt, Artificial Sequence
  derived and/or modified sequence opt4 from anti-HIV_119-057473_VR-Chain
cagagcgugcugacccagccccccagcgugagcgccgcccccggccagaaggugaccaucagcugcagcggcagcagcagcaacaucggcaacaacuacgugagcugguaccagcaccugcccggcaccgcccccaagcugcugaucuacgacaccuacagcagacccagcggcauccccgacagauucagcggcagcaagagcggcaccagcgccacccuggccaucaccggccugcagaccggcgacgaggccgacuacuacugcggcaccugggacggcagcggcggcguguucggcaccggcaccaaggugaccgugcug

SEQ ID NO: 33000 - RNA, 321 nt, Artificial Sequence
  derived and/or modified sequence opt4 from anti-HIV_119-057090_VR-Chain
cagagcgugcugacccagccccccagcgugagcgccgcccccggccagaccgugaccaucagcugcagcggcagcaccagcaacaucggcaagaacgacgugagcugguaccagcagcugcccggcaccgcccccaagcugcugaucagcgagaacaacagaagacccagcggcacccccgacagauucagcgccagcaagagcggcaccagcgccacccuggccaucaccggccugcagaccggcgacgaggccgacuacuucugcagcaccuggagcggcagccugaacuucggcaccggcaccagagugaccgugcug

SEQ ID NO: 33001 - RNA, 333 nt, Artificial Sequence
  derived and/or modified sequence opt4 from anti-HIV_119-055754_VR-Chain
cagagcgugcugacccagccccccagcgugagcgccgcccccggccagaaggugaccaucagcugcagcggcaacagcagcagcaucggcaacaacuucgugagcugguaccagcagcugcccggcaccgcccccaagcugcugguguacgagaacuacagaagacccagcggcauccccgacagauucagcggcagcaagagcggcaccagcgccacccuggccaucgacggccugcagaccugggacgaggccgacuaccacugcgccaucuggggcgugagaaagggcgugggcgccguguucggcaccggcaccaaggugaccguggug

SEQ ID NO: 33002 - RNA, 324 nt, Artificial Sequence
  derived and/or modified sequence opt4 from anti-HIV_119-054899_VR-Chain
cagagcgugcugacccagccccccagcgugagcgccgcccccggccagaaggugaccaucagcugcagcggcagcaacagcuacaucggcaacaaguacgugagcugguaccagcaguuccccggcaccgcccccaagcugcugauccacgagaacaacagaagacccagcggcacccccgacagauucagcggcagcaagagcggcaccagcgccacccuggccaucagcggccugcagaccggcgacgaggccgacuacuacugcgagaccugggacggcagcggcggcguguucggcaccggcaccaaggugaccgugcug

SEQ ID NO: 33003 - RNA, 324 nt, Artificial Sequence
  derived and/or modified sequence opt4 from anti-HIV_119-054501_VR-Chain
cagagcgugcugacccagccccccagcgugagcgccgcccccggccagaaggugaccaucagcugcagcggcaccagcagcaacaucggcaacaacuacgugagcugguaccagcaccugcccggcaccgcccccaagcugcugaucuucgagaccaacaagagacccagcggcauccccgacagauucagcgccagcaagagcggcaccagcgccacccuggccaucaccggccugcagaccggcgacgaggccgacuacuacugcgagaccugggacggcagcggcggcguguucggccccggcaccagagugaccgugcug

SEQ ID NO: 33004 - RNA, 324 nt, Artificial Sequence
  derived and/or modified sequence opt4 from anti-HIV_119-051867_VR-Chain
cagagcgugcugacccagccccccagcgugagcgccgcccccggccagaaggugaccaucagcugcagcggcaacagcagcaacaucggcaacaacuucaucagcugguaccagcagcugcccggcaccgcccccaagcugcugaucuacgagaacgacagaagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 33005 - RNA, 324 nt, Artificial Sequence
  derived and/or modified sequence opt4 from anti-HIV_119-051814_VR-Chain
cagagcgugcugacccagccccccagcgugagcgccgcccccggccagaaggugaccaucagcugcagcggcagcaacagcaacaucggcaacaaggacgugagcugguaccagcagauccccgccaccgcccccaagcugcugaucuacgagaacaacaagagacccagcggcauccccgacagauucagcggcagcaagagcggcaccagcgccacccuggccaucaccggccugcagaccggcgacgaggccgacuacuacugcgccaccugggacggcagagugagcgugaucggcaccggcaccaacgugaucgugcug

SEQ ID NO: 33006 - RNA, 321 nt, Artificial Sequence
  derived and/or modified sequence opt4 from anti-HIV_119-051567_VR-Chain
cagagcgugcugacccagccccccagcgugagcgccgcccccggccagaaggugaccaucuacugcagcggcagcagaagcaacaucggcagaaacuacgccagcugguaccagcagcugcccggcaccgcccccaagcugcugaucuucgacaacaacagaagacccagcggcauccccgacagauucagcggcgccaagagcggcaccagcgccacccuggccaucaccggccugcagaccggcgacgaggccgacuacuucugcagcaccuggagcggcagccugaacuucggcaccggcaccagagugaccgugcug

SEQ ID NO: 33007 - RNA, 324 nt, Artificial Sequence
  derived and/or modified sequence opt4 from anti-HIV_119-051483_VR-Chain
cagagcgugcugacccagccccccagcgugagcgccgcccccggccagaagcugaccaucagcugcagcggcaccagcagcaacaucggcaacaacuacgugagcugguaccagcaccugcccggcaccgcccccaagcugcugaucuacgagaacaacagaagacccagcggcauccccgagagauucagcgccagcaagagcggcaccagcgccacccugggcaucaccggccugcagaccggcgacgaggccgacuacuacugcgagaccugggacgacagcggcggcguguucggcaccggcaccaaggugaccgugcug

SEQ ID NO: 33008 - RNA, 333 nt, Artificial Sequence
  derived and/or modified sequence opt4 from anti-HIV_119-050913_VR-Chain
cagagcgugcugacccagccccccagcgugagcgccgcccccggccagaaggugaccaucagcugcagcggcggcaccagcaacaucggcaacaacuacgugagcugguaccagcagcugcccggcaccgcccccagacugcugaucuacgagaccaacaagagacccagcggcauccccgacagauucuucggcagcaagagcggcaccagcgccacccuggccaucagcggccugcagaccggcgacgaggccgacuacuacugcaccguguggggcgugagaaagggcgugggcgccguguucggcaccggcaccaaggugaccgugcug

SEQ ID NO: 33009 - RNA, 333 nt, Artificial Sequence
  derived and/or modified sequence opt4 from anti-HIV_119-050187_VR-Chain
cagagcgugcugacccagccccccagcgugagcgccgcccccggccagaaggugaccaucagcugcagcggcagcagcagcaacaucggcaagaacagcgugagcugguaccagcaguuccccggcaccgcccccaagcugcugaucuacgagaacaacaagagacccagcggcauccccgacagauucagcgacagccagagcggcaccagcgccacccuggccaucaccggccugcagaccggcgacgaggccgacuacagcugcgccaccugggccgccagccugaacagcgccagaguguucggcaccggcaccagagugaccgugcug

SEQ ID NO: 33010 - RNA, 324 nt, Artificial Sequence
  derived and/or modified sequence opt4 from anti-HIV_119-049069_VR-Chain
cagagcgugcugacccagccccccagcgugagcgccgcccccggccagaaggugaccaucagcugcagcggcagcaccagcaacaucggcaagagcgacguguucugguaccagcagcugcccggcaccgcccccaagcugcugaucagcgagaccagcagaagacccagcggcacccccgacagauucagcggcagcaagagcggcaccagcgccacccugaccaucaccggccugcagaccggcgacgaggccgacuacuacugcgaggccugggacggcagcggcggcguguucggcaccggcaccaaggugaccgugcug

SEQ ID NO: 33011 - RNA, 333 nt, Artificial Sequence
  derived and/or modified sequence opt4 from anti-HIV_119-048517_VR-Chain
cagagcgugcugacccagccccccagcgugagcgccgcccccggccagaaggugaccaucagcugcagcggcagcaaguucaacaucggcaacaaggacgugagcugguaccagcacagccccggcaccgcccccaagcugcugaucuacgagaacaacaagagacccagcggcauccccgacagauucagcggcagcaagagcggcaccagcgccacccugggcaucagcggccugcagaccggcgacgaggccgacuacugcugcgccguguggggcgugagaagaggcgccggcgccguguucggcgccggcaccaaggugaccgugcug

SEQ ID NO: 33012 - RNA, 333 nt, Artificial Sequence
  derived and/or modified sequence opt4 from anti-HIV_119-048470_VR-Chain
cagagcgugcugacccagccccccagcgugagcgccgcccccggccagaaggugaccaucagcugcagcggcagcaccagcaacaucggcaagaaccuggugagcugguaccagcaguuccccggcaccgcccccaagcugcugaucuacgagaacaacagaagacccagcggcauccccgacagauucagcggcagcaagagcggcaccagcgccacccuggugaucaccggccugcagaccggcgacgaggccgacuucuacugcggcaccuggggcggcagccugagagccggcggcgugaucggcaccggcaccagagugaccgugcug

SEQ ID NO: 33013 - RNA, 282 nt, Artificial Sequence
  derived and/or modified sequence opt4 from anti-HIV_119-048303_VR-Chain
agcgugcugacccagccccccagcgugagcgccgcccccggccagaacaucaccaucagcugcagcggcagcaucagcaacaucgccagcaacuucaucagcugguaccagcagcugcccggcaccgcccccaagaucaucaucuacgacaacgaccagagaccccugggcauccccgccagauucagcggcagcaagagcggcgccagcgccacccuggugaucaccggccugcagaccggcgacgaggccgacuacuacugcggcaccugggacggcagc

SEQ ID NO: 33014 - RNA, 333 nt, Artificial Sequence
  derived and/or modified sequence opt4 from anti-HIV_119-048021_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgacaacaacaagagacccagcggcauccccgacagauucagcggcagcaagagcggcaccagcgccacccuggugaucaccggccugcagaccggcgacgaggccgacuucuacugcggcaccugggacggcagccugagcggcggcggcgugaucggcaccggcaccagagugaccgugcug

SEQ ID NO: 33015 - RNA, 324 nt, Artificial Sequence
  derived and/or modified sequence opt4 from anti-HIV_119-047928_VR-Chain
cagagcgugcugacccagccccccagcgugagcgccgcccccggccagaaggugaccaucagcugcagcggcagcaacagcaacaucggcaacaacugcgugagcugguaccagcaggugcccggcaccgcccccaagcugcugaucuacgagaacaacagaagacccagcggcauccccgacagauucagcggcagcaagagcggcaccagcgccacccuggccaucagcggccugcagaccggcgacgaggccgacuacuacugcggcaccugggacggcagcggcggcguguucggcaccgccaccaaggugaccgugcug

SEQ ID NO: 33016 - RNA, 324 nt, Artificial Sequence
  derived and/or modified sequence opt4 from anti-HIV_119-047384_VR-Chain
cagagcgugcugacccagccccccagcgugagcgccgcccccggccagaaggugaccaucagcugcagcggcagcaacagcaacaucggcaacaaggacgugagcugguacagacaggugccccccaccgcccccaagcugcugaucuacgagaacaacaagagacccagcggcauccccgacagauucagcggcagcaagagcggcaccagcgccacccuggccaucaccggccugcagaccggcgacgaggccgacuacuacugcgccaccugggacggcagagugagcguguucggcaccggcaccaagguggccgugcug

SEQ ID NO: 33017 - RNA, 333 nt, Artificial Sequence
  derived and/or modified sequence opt4 from anti-HIV_119-047145_VR-Chain
cagagcgugcugacccagccccccagcgugagcgccgcccccggccagaccgugaacaucagcugcagcggcagcaacagcaacaucggcagcaaguacgugagcugguaccagcacuuccccggcaccgcccccaagcugcugaucuacgagaacaacaagagaagcagcggcauccccgacagauucagcggcagcaagagcgccaccagcgccacccuggccaucaccggccugcagaccggcgacgaggccgacuacuacugcgccaccugggcccccagccugaacagcgccagaguguucggcaccggcaccaaggugaccgugcug

SEQ ID NO: 33018 - RNA, 333 nt, Artificial Sequence
  derived and/or modified sequence opt4 from anti-HIV_119-046752_VR-Chain
cagagcgugcugacccagccccccagcgugagcgccgcccccggccagaaggugaccaucagcugcagcggcaacagcagcagcaucggcaacaacuucgugagcugguaccagcagcugcccggcaccgcccccaagcugcugguguacgagaacuacagaagacccagcggcaucagcgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 33019 - RNA, 324 nt, Artificial Sequence
  derived and/or modified sequence opt4 from anti-HIV_119-046660_VR-Chain
cagagcgugcugacccagccccccagcgugagcgccgcccccggccagaaggugaccaucagcugcagcggcagcagcagcaacaucggcaaccacuacgugagcugguaccagcagcugcccggcaccgcccccaagcugcugaucuacgacaacaacaagagacccagcggcauccccgacagauucagcgccagcaagagcggcaccagcgccacccugggcaucaccggccugcagaccggcgacgaggccgacuacuacugcgccaccugggacggcagagugagcgugaucggcaccggcaccaaggugaccguggug

SEQ ID NO: 33020 - RNA, 333 nt, Artificial Sequence
  derived and/or modified sequence opt4 from anti-HIV_119-046202_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugguguacgagaacuacagaagacccagcggcauccccgacagauucagcggcagcaagagcggcaccagcgccacccuggccaucaccggccugcagaccggcgacgaggccgacuaccacugcgccaucuggggcgugagaaagggcgugggcgccguguucggcaccggcaccaaggugaccguggug

SEQ ID NO: 33021 - RNA, 333 nt, Artificial Sequence
  derived and/or modified sequence opt4 from anti-HIV_119-045790_VR-Chain
cagagcgugcugacccagccccccagcgugagcgccgcccccggccagaaggugaccaucagcugcagcggcagcagcagcaacaucggcaacaacuacgugagcugguaccaguaccugcccggcaccgcccccaagcugcuguucuacgaggacaacagaagacccagcggcacccccgacagauucagcggcagcaagagcggcaccagcgccacccuggccaucagcggccugcagaccggcgacgaggccgacuacuacugcaccaucuggggcgugagaaagggcgugggcgccguguucggcaccggcaccaaggugaccgugcug

SEQ ID NO: 33022 - RNA, 333 nt, Artificial Sequence
  derived and/or modified sequence opt4 from anti-HIV_119-044670_VR-Chain
cagagcgugcugacccagccccccagcgugagcggcgcccccggcgagagagugaccaucagcugcaccggcaacaccagcaacaucggcaccuacgacgugcagugguaccagcaccugcccggcaccgcccccagacugcugaucuaccacaacgugaaccugcccagcggcgugcccgacagauucagcgccagcaagagcggcaccagcgccacccuggccaucaccggccugcagaccggcgacgaggccgacuacuacugcaccaucuggggcgugagaaagggcgugggcgccguguucggcaccggcaccaaggugaccgugcug

SEQ ID NO: 33023 - RNA, 321 nt, Artificial Sequence
  derived and/or modified sequence opt4 from anti-HIV_119-044140_VR-Chain
cagagcgugcugacccagccccccagcgugagcgccgcccccggccagaaggugaccaucagcugcagcggcggcaccagcaacaucggcaaccacuucgugagcugguacagacaccugcccggcaccgcccccaagcugcugaucuacgagaacaacaacagacccagcggcauccccgacagauucagcggcgccaagagcggcaccagcgccacccuggccaucaccggccugcagaccggcgacgagggcgacuacuacugcgccaccuggagcggcagccugaacaucggcaccggcaccaaggugaccgugcug

SEQ ID NO: 33024 - RNA, 333 nt, Artificial Sequence
  derived and/or modified sequence opt4 from anti-HIV_119-042776_VR-Chain
cagagcgugcugacccagccccccagcgugagcgccgcccccggccagaaggugaccaucagcugcagcggcagcagcagcaacaucggcaacaacuacgugagcugguaccagcaccugcccggcaccgcccccaagcugcugaucuacgagagcgccagaagacccagcggcacccccgacagauucagcggcagcaagagcggcaccagcgccacccuggccaucaccggccugcagaccggcgacgaggccgacuacuacugcacccuguggggcgugagaaagggcgugggcgccguguucggcaccggcaccagagugaccgugcug

SEQ ID NO: 33025 - RNA, 333 nt, Artificial Sequence
  derived and/or modified sequence opt4 from anti-HIV_119-042581_VR-Chain
cagagcgugcugacccagccccccagcgugagcgccgcccccggccagaaggugaccaucagcugcagcggcagcagcagcaacaucggcaacaacuucgugagcugguaccagcagcugcccggcaccgcccccaagcugcugaucuucgagacccacagaagacccagcggcauccccgacagauucagcggcagcaagagcggcaccagcgccacccuggccaucaccggccugcagagcggcgacgaggccgacuacuacugcgccguguggggcgugagacagggcgccggcgccguguucggcaccggcaccaaggugaccgugcug

SEQ ID NO: 33026 - RNA, 333 nt, Artificial Sequence
  derived and/or modified sequence opt4 from anti-HIV_119-040905_VR-Chain
cagagcgugcugacccagccccccagcgugagcgccgcccccggccagaaggugaccaucagcugcagcggcaacagcagcaacaucggcgacaacuucgugagcugguaccagcagcugcccggcaucgcccccaagcugcugguguacgagaccaacaagagacccagcggcauccccgacagauucgccggcagcaagagcggcaccagcgccacccuggugaucaccggccugcagaccggcgacgaggccgacuucuacugcggcaccugggacggcagccugagaaccggcggcgugaucggcaccggcaccagagugaccgugcug

SEQ ID NO: 33027 - RNA, 321 nt, Artificial Sequence
  derived and/or modified sequence opt4 from anti-HIV_119-040322_VR-Chain
cagagcgugcugacccagccccccagcgugagcgccgcccccggccagaagguggugaucagcugcagcggcagcagcagcaucaucgagaagaacagcaucagcugguaccagcagggccccggcgccgcccccaagcugcugaucuacgagaacgacaagagacccagcggcauccccgacagauucagcggcagcaagagcggcaccaccggcacccuggccaucaccggccugcagaccggcgacgaggccgacuacuucugcgccaccuggagcggcagacugaacaucggcaccggcaccaaggugaccgugcug

SEQ ID NO: 33028 - RNA, 324 nt, Artificial Sequence
  derived and/or modified sequence opt4 from anti-HIV_119-039892_VR-Chain
cagagcgugcugacccagccccccagcgugagcgccgcccccggccagaaggugaccaucagcugcagcggcagcaacgccaacaucggcaacaaggacgugagcugguaccagcagcugcccgccaccgcccccaagcugcugaucuacgagagcaacaagagacccagcggcauccccgacagauucagcggcagcaagagcggcaccagcgccacccuggccaucaccggccugcagaccggcgacgaggccgacuacuacugcgccaccugggacggcagagugagcggcaucggcaccggcaccaaggugaccgugcug

SEQ ID NO: 33029 - RNA, 324 nt, Artificial Sequence
  derived and/or modified sequence opt4 from anti-HIV_119-039764_VR-Chain
cagagcgugcugacccagccccccagcgugagcgccgcccccggccagaaggugaccaucagcugcagcggcagcgccagcaacaucggcaagaacuucgugagcugguaccagcaggugcccggcaccgcccccaagcugcugaucuacgagaacaacagaagacccagcggcacccccgacagauucagcggcagcaagagcggcaccagcggcacccuggccaucagcggccugcagaccggcgacgaggccgacuacuacugcgagaccugggacggcagcggcggcguguucggcaccggcaccaaggugaccgugcug

SEQ ID NO: 33030 - RNA, 333 nt, Artificial Sequence
  derived and/or modified sequence opt4 from anti-HIV_119-039188_VR-Chain
cagagcgugcugacccagccccccagccugagcggcgcccccggccagaccgugaccaucagcugcagcggcagcagcagcaacaucggcaacaacuacgugagcugguaccagcagcugcccggcaccgcccccaagcugcugaucuacgacagcaacagaagacccagcggcauccccgacagauucagcggcagcaagagcggcaccagcgccacccuggccaucagcggccugcagaccggcgacgaggccgacuacugcugcgccguguggggcgugagaagaggcgccggcgccguguucggcgccggcaccaaggugaccgugcug

SEQ ID NO: 33031 - RNA, 321 nt, Artificial Sequence
  derived and/or modified sequence opt4 from anti-HIV_119-039058_VR-Chain
cagagcgugcugacccagccccccagcgugagcggcgcccccggccagagagugaccaucagcugcaccggcagcagcagcaacaucggcaacaacuacgugagcugguacagaagacugcccggcaccgcccccaagcugcugaucuacgagaacaacaagagacccagcggcauccccgacagauucagcggcgccaagagcggcaccagcgccacccuggccaucaccggccugcagaccggcgacgaggccgacuacuucugcagcaccuggagcggcagccugaacuucggcaccggcaccagagugaccgugcug

SEQ ID NO: 33032 - RNA, 321 nt, Artificial Sequence
  derived and/or modified sequence opt4 from anti-HIV_119-038837_VR-Chain
cagagcgugcugacccagccccccagcgugagcgccgcccccggccagaaggugaccaucagcugcagcggcggcaccagcaacaucggcaacaacuucgugagcugguaccagcaccugcccggcaccgcccccaagcugcugaucuucgagaacaacaagagacccagcggcgugcccgacagauucagcggcgccaagagcggcaccagcgccacccuggccaucaccggccugcagaccggcgacgagggcgacuacuacugcgccaccuggagcggcagccugaacaucggcaccggcaccaaggugaccgugcug

SEQ ID NO: 33033 - RNA, 321 nt, Artificial Sequence
  derived and/or modified sequence opt4 from anti-HIV_119-038396_VR-Chain
cagagcgugcugacccagccccccagcgugagcgccacccccggccagaaggugaccaucagcugcagcggcagcaacagcaacaucggcaacaaguacgugagcugguaccagcuguuccccggcaccgcccccaagcugcugaucagcgagaacaacagaagacccagcggcacccccgacagauucagcggcagcaagagcggcaccagcgccacccuggccaucaccggccugcagaccggcgacgaggccgacuacuacugcgccaccuggagcggcagccugaacaucggcaccggcaccaaggugaccgugcug

SEQ ID NO: 33034 - RNA, 321 nt, Artificial Sequence
  derived and/or modified sequence opt4 from anti-HIV_119-036918_VR-Chain
cagagcgugcugacccagccccccagcgugagcgccgcccccggccagaaggugaccaucagcugcagcggcgccaccagcaacaucugggaccacuacgugagcugguaccugcaggugcccggcaccgcccccagacugcugaucuacgacaacgacaagagacccagcggcauccccgacagauucagcggcagcaagagcggcaccagcgccacccuggccaucaccggccugcagaccggcgacgagggcgacuacuacugcgccaccuggagcggcagccugaacaucggcaccggcaccaaggugaccgugcug

SEQ ID NO: 33035 - RNA, 324 nt, Artificial Sequence
  derived and/or modified sequence opt4 from anti-HIV_119-036592_VR-Chain
cagagcgugcugacccagccccccagcgugagcgccgcccccggccagaaggugaccaucagcugcagcggcagcaacagcaacaccggcaacaaggacgugagcugguaccagcaggugcccgccaccgcccccaagcugcugaucuacgagagcaacaagagacccagcggcauccccgacagauucagcggcagcaagagcggcaccagcgccacccuggccaucaccggccugcagaccggcgacgaggccgacuacuacugcgccaucugggacggcagagugagcgugaucggcaccggcaccaaggugaccgugcug

SEQ ID NO: 33036 - RNA, 324 nt, Artificial Sequence
  derived and/or modified sequence opt4 from anti-HIV_119-036310_VR-Chain
cagagcgugcugacccagccccccagcgugagcgccgcccccggccagaaggugaccaucagcugcagcggcagcaccagcaacaucggccagaacuacgugagcugguaccagcagcugcccggcaccgcccccaagcugcugaucuacgagaacaacagaagacccagcggcagccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 33037 - RNA, 333 nt, Artificial Sequence
  derived and/or modified sequence opt4 from anti-HIV_119-035618_VR-Chain
cagagcgugcugacccagccccccagcgugagcgccgcccccggccagaaggugaccaucagcugcagcggcagcagcuucaccaucggcaacaaccacgugagcugguaccagcagcugcccggcaccgcccccaagcugcugaucuucgagagccacaagagacccagcggcgugcccgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 33038 - RNA, 321 nt, Artificial Sequence
  derived and/or modified sequence opt4 from anti-HIV_119-035569_VR-Chain
cagagcgugcugacccagccccccagcgugagcggcgcccccggccagaccgugaccaucagcugcaccggcagcagcagcaacaucggcggcuacgacgugcacugguaccagcagcugcccggcaccgcccccaagcugcugaucuacgagaacaacagaagacccagcggcacccccgacagauucagcggcgccaagagcggcaccagcgccacccuggccaucaccggccugcagaccggcgacgagggcgacuacuacugcgccaccuggagcggcagccugaacaucggcaccggcaccaaggugaccgugcug

SEQ ID NO: 33039 - RNA, 324 nt, Artificial Sequence
  derived and/or modified sequence opt4 from anti-HIV_119-035466_VR-Chain
cagagcgugcugacccagccccccagcgugagcgccgccgccggccagaacgugaacaucagcugcagcggcaagaagagcaacaucggcaacaacuacgugagcugguaccagcaguuccccggcaccgcccccaagcugcugaucuacggcaacaccaacagacccagcggcauccccgacagauucagcggcagcaagagcggcaccagcgccacccuggccaucaccggccugcagaccggcgacgacgccgacuacuacugcgagaccugggacggcagcggcggcguguucggcaccggcaccaaggugaccgugcug

SEQ ID NO: 33040 - RNA, 333 nt, Artificial Sequence
  derived and/or modified sequence opt4 from anti-HIV_119-035157_VR-Chain
cagagcgugcugacccagccccccagcgugagcgccgcccccggccagaaggugaccaucagcugcagcggcagcagcagcaacaucggcaacaacuucgugagcugguaccagcagagacccggcaccgcccccaagcugcugaucuacgagaccaacaagagacccagcggcauccccgacagauucagcggcagcaagagcggcaccagcgccacccuggccaucaccggccugcagaccggcgacgaggccgacuacuacugcgccaccugggcccccagacugaacagcgccagaguguucggcaacggcaccauggugaccgugcug

SEQ ID NO: 33041 - RNA, 333 nt, Artificial Sequence
  derived and/or modified sequence opt4 from anti-HIV_119-035121_VR-Chain
cagagcgugcugacccagccccccagcgugagcgccgcccccggccagaaggugaccaucagcugcagcggcagcaccagcuacaucggcaacaaguacgugagcugguaccagcaguuccccggcgccgcccccaagcugcugaucuacgagaacaacaagagacccagcggcauccccgacagauucagcgccagcaagagcgccaccagcgccacccuggccaucaccggccugcagaccggcgacgaggccgacuacugcugcgccguguggggcgugagaagaggcgccggcgccguguucggcgccggcaccaaggugaccgugcug

SEQ ID NO: 33042 - RNA, 324 nt, Artificial Sequence
  derived and/or modified sequence opt4 from anti-HIV_119-035046_VR-Chain
cagagcgcccugacccagcccgccagcgugagcggcagccccggccagagcaucaccaucagcugcaccggcaccagcagcgacgugggcuacgacuacgugagcugguacagacaggugcccgccaccacccccaagcugcugaucuacgagaacaacaagagacccagcggcauccccgacagauucagcggcagcaagagcggcaccagcgccacccuggccaucaccggccugcagaccggcgacgaggccgacuacuacugcgccaccugggacggcagagugagcgugaucggcaccggcaccaaggugaccguggug

SEQ ID NO: 33043 - RNA, 324 nt, Artificial Sequence
  derived and/or modified sequence opt4 from anti-HIV_119-034754_VR-Chain
cagagcgugcugacccagccccccagcgugagcgccgcccccggcgagaaggugaccaucagcugcagcggcagcagcagcaacaucggcaacaacuacgugagcugguaccagcagcugcccggcaccgugcccaagcugcugaucuacgacaacaacaagagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 33044 - RNA, 324 nt, Artificial Sequence
  derived and/or modified sequence opt4 from anti-HIV_119-034318_VR-Chain
cagagcgugcugacccagccccccagcgugagcgccgcccccggccagaagaucaccaucagcugcagcggcagcagcagcaacaucggcaacaacgacgugagcugguaccagcagcugcccggcaccgcccccaagcugcugaucuacgagaacgacagaagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 33045 - RNA, 333 nt, Artificial Sequence
  derived and/or modified sequence opt4 from anti-HIV_119-033780_VR-Chain
cagagcgugcugacccagccccccagcgugagcgccgcccccggccagagagugaccaucagcugcagcggcaccagcagcaacaucggcgagaacuacgugagcugguaccagcagauccccggcaccgcccccaagcugcugaucuacgagaacaacaagagacccagcggcauccccgacagauucagcggcagcaagagcggcaccagcgccacccuggugaucaccggccugcagaccggcgacgaggccgacuucuacugcggcaccuggggcggcagccugagaaccggcggcgugcugggcaccggcaccagagugaccgugcug

SEQ ID NO: 33046 - RNA, 333 nt, Artificial Sequence
  derived and/or modified sequence opt4 from anti-HIV_119-033632_VR-Chain
cagagcgugcugacccagccccccagcgugagcgccgcccccggccagagagugaccaucagcugcagcggcggcagcagcaacaucggcagcaacuacgugagcugguaccagcagcugcccggcaccgcccccaagcugcugaucuaccagaacaacaagagacccagcggcauccccgacagauucagcggcagcaagagcggcaccagcgccacccugggcaucaccggccugcagaccggcgacgaggccgacuacuacugcaccguguggggcgugagaaagggcgugggcgccguguucggcaccggcaccaaggugaccgugcug

SEQ ID NO: 33047 - RNA, 333 nt, Artificial Sequence
  derived and/or modified sequence opt4 from anti-HIV_119-033183_VR-Chain
cagagcgugcugacccagccccccagcgugagcgccgcccccggccagauggugaccaucagcugcagcggcggcgccagcaaccugggcaagaacagcgugagcugguaccagcagcugcccggcaccgcccccaagcugcugaucuacgaggacaacagaagacccagcggcacccccgacagauucagcggcagcagaagcggcaccagcgccacccuggccaucaccggccugcagaccggcgacgaggccgacuacuacugcaccaucuggggcgugagaaagggcgugggcgccguguucggcaccggcaccaaggugaccgugcug

SEQ ID NO: 33048 - RNA, 333 nt, Artificial Sequence
  derived and/or modified sequence opt4 from anti-HIV_119-030696_VR-Chain
cagagcgugcugacccagccccccagcgugagcggcgcccccggccagaucgugacccugagcugcaccggcgccaugaccaacaucggcaacaacgacgugcacugguaccagcaccugcccggcaccggccccaagcugcugaucuacgagaacaacaagagacccagcggcauccccgacagauucagcggcagcaagagcggcaccagcgccacccuggugaucaccggccugcagaccggcgacgaggccgacuucuacugcggcaccugggacggcagccugagaaccggcggcgugaucggcaccggcaccagagugaccgugcug

SEQ ID NO: 33049 - RNA, 324 nt, Artificial Sequence
  derived and/or modified sequence opt4 from anti-HIV_119-030059_VR-Chain
cagagcgugcugacccagccccccagcgugagcgccgcccccggccagaagguggugaucagcugcagcggcagcagcagcaucaucgagaagaacagcaucagcugguaccagcagggccccggcgccgcccccaagcugcugaucuacgagaacgacaagagacccagcggcaucagcgacagauucagcggcagcaagagcgccaccagcgccacccuggccaucaccggccugcacaccggcgacgaggccgacuacuacugcgagaccugggacggcagcggcggcguguucggcaccggcaccaaggugaccgugcug

SEQ ID NO: 33050 - RNA, 333 nt, Artificial Sequence
  derived and/or modified sequence opt4 from anti-HIV_119-029589_VR-Chain
cagagcgugcugacccagccccccagcgugagcgccgcccccggccagaaggugaccaucagcugcagcggcaccagcagcaacaucggcaacaacuucgugagcugguaccagcugcugcccggcaccgcccccagacugcugaucuacgacaacaacaagagacccagcggcacccccgacagauucagcggcagcaagagcggcaccagcgccacccugggcaucaccggccugcagaccggcgacgaggccgacuucuacugcggcaccugggacggcagccugagaaccggcggcgugaucggcaccggcaccagagugaccgugcug

SEQ ID NO: 33051 - RNA, 324 nt, Artificial Sequence
  derived and/or modified sequence opt4 from anti-HIV_119-029448_VR-Chain
cagagcgugcugacccagccccccagcgugagcgccgcccccggccagaaggugaccaucagcugcagcggcaacagcagcaacaucggcaagaacagcgugagcugguaccaccagcugcccggcaccgcccccaagcugcugaucuacgagaacgacagaagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 33052 - RNA, 333 nt, Artificial Sequence
  derived and/or modified sequence opt4 from anti-HIV_119-029220_VR-Chain
cagagcgugcugacccagccccccagcgugagcgccgcccccggccagaaggugaccaucagcugcagcggcagcaccagcaacaucggccagaacuacgugagcugguaccagcagcugcccggcaccgcccccaagcugcugaucuacgagaacgacagaagacccagcggcauccccgacagauucagcggcagcaagagcggcaccagcgccacccuggccaucagcggccugcagaccggcgacgaggccgacuacugcugcgccguguggggcgugagaagaggcgccggcgccguguucggccccggcaccaaggugaccgugcug

SEQ ID NO: 33053 - RNA, 333 nt, Artificial Sequence
  derived and/or modified sequence opt4 from anti-HIV_119-028317_VR-Chain
cagagcgugcugacccagccccccagcgugagcgccgcccccggccagaaggugaccaucagcugcagcggcagcagcagcaacaucggcaacgacuacgugagcugguaccagcagcugcccggcaccgcccccaagcugcugaucuacgagaacaacaagagacccagcggcauccccgacagauucagcggcagcaagagcggcaccagcgccacccuggccaucaccggccugcagaccggcgacgaggccgacuacuacugcaccaucuggggcgugagaaagggcgugggcgccguguucggcaccggcaccaaggugaccgugcug

SEQ ID NO: 33054 - RNA, 324 nt, Artificial Sequence
  derived and/or modified sequence opt4 from anti-HIV_119-028165_VR-Chain
cagagcgugcugacccagccccccagcgugagcgccgcccccggccagaccgugaccaucagcugcagcggcaucaccagcaacaucggcaagaacgacgugagcugguaccagcagcugcccggcaccgcccccaagcugcugaucagcgagaacaacagaagacccagcggcauccccgacagauucagcggcagcaagagcggcaccagcgccacccuggccaucaccggccugcagaccggcgacgaggccgacuacuacugcgccaucugggacggcagagugagcgugaucggcaccggcaccaaggugaccgugcug

SEQ ID NO: 33055 - RNA, 324 nt, Artificial Sequence
  derived and/or modified sequence opt4 from anti-HIV_119-027147_VR-Chain
cagagcgugcugacccagccccccagcgugagcgccgcccccggccagaccgugaccaucagcugcagcggcagcaccagcgacaucggcaagaacgacgugagcugguaccagcagcugcccggcaucgcccccaagcugcugaucagcgagaacaacagaagacccagcggcacccccgacagauucagcggcagcaagagcggcaccagcgccacccuggccaucaccggccugcagaccggcgacgaggccgacuacuacugcgagaccugggacggcagcggcgccguguucggcaccggcaccaaggugaccgugcug

SEQ ID NO: 33056 - RNA, 333 nt, Artificial Sequence
  derived and/or modified sequence opt4 from anti-HIV_119-026743_VR-Chain
cagagcgugcugacccagccccccagcgugagcgccgcccccggccagaacgugaccaucagcugcagcggcagcagcagcaacaucggcaacaacuucgugagcugguaccagcagagacccggcaccggccccaagcugcugaucuacgagaccaacagaagacccagcggcauccccgacagauucagcggcagcaagagcggcaccagcgccacccuggccaucaccggccugcagaccggcgacgaggccgacuacuacugcgccaccugggcccccagccugaacagcgccagaguguucggcaccggcaccaaggugaccgugcug

SEQ ID NO: 33057 - RNA, 333 nt, Artificial Sequence
  derived and/or modified sequence opt4 from anti-HIV_119-026508_VR-Chain
cagagcgugcugacccagccccccagcgugagcgccgcccccggccagaaggugaccaucagcugcagcggcagcagcagcaccaucggcaacaacuacaucagcugguaccaggugcugcccggcaccgcccccaagcuggugaucuucaagaacaacgagagacccagcagagugcccgacagauucagcggcagcaagagcggcaccagcgccacccugggcaucaccggccugcagcugggcgacgagggcgacuacuacugcggcaccugggagaccagccugagcggcggcggcguguucggcaccggcaccaaggugaccgugcug

SEQ ID NO: 33058 - RNA, 324 nt, Artificial Sequence
  derived and/or modified sequence opt4 from anti-HIV_119-025683_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaacaacaagagacccagcggcauccccgacagauucagcgacagccagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 33059 - RNA, 333 nt, Artificial Sequence
  derived and/or modified sequence opt4 from anti-HIV_119-025614_VR-Chain
cagagccugcugacccagccccccagcgugagcgccgcccccggccagaacgugaucaucagcugcagcggcagcagcagcaacaucggcaagaacuacguggccugguaccagcaggugcccggcaccgcccccaagaucgugguguucgagaccaccaacagacccagcggcauccccgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 33060 - RNA, 324 nt, Artificial Sequence
  derived and/or modified sequence opt4 from anti-HIV_119-025548_VR-Chain
cagagcauccugacccagccccccagcgugagcgccgcccccggccagaaggugaccaucagcugcagcggcagcagcagcaacaucggcaacaacuacgugagcugguaccagcacgugcccggcaccgcccccaagcugcugaucuacgagaacaacagaagacccagcggcacccccgacagauucagcggcagcaagagcggcaccagcgccacccuggccaucaccggccugcagagcggcgacgaggccgacuacuacugcggcaccugggacggcagcggcggcguguucggcaccggcaccaaggugaccgugcug

SEQ ID NO: 33061 - RNA, 333 nt, Artificial Sequence
  derived and/or modified sequence opt4 from anti-HIV_119-025526_VR-Chain
cagagcgugcugacccagccccccagcgugagcgccgcccccggccagaaggugaccaucagcugcagcggcagcgccagcaacaucggcaagaacuucgugagcugguaccagcagcugcccggcaccgcccccaagcugcugaucuacgagaacaacagaagacccagcggcacccccgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 33062 - RNA, 324 nt, Artificial Sequence
  derived and/or modified sequence opt4 from anti-HIV_119-023552_VR-Chain
cagagcgugcugacccagccccccagcgugagcgccgcccccggccagaccgugaccaucagcugcagcggcagcaccagcaacaucggcaagaacgacgugagcugguaccagcagcugcccggcaccgcccccaagcugcugaucagcgagaacaacagaagacccagcggcacccccgacagauucagcgccagcaagagcggcaccagcgccacccuggccaucaccggccugcagaccggcgacgaggccgacuacuacugcgagaccuggcacggcagcggcggcguguucggcaccggcaccaaggugaccgugcug

SEQ ID NO: 33063 - RNA, 321 nt, Artificial Sequence
  derived and/or modified sequence opt4 from anti-HIV_119-023092_VR-Chain
cagagcgugcugacccagccccccagcgugagcgccgcccccggccagaaggugaccaucagcugcagcggcagcaccagcgaccugggccagaccagagugagcugguaccagcagcugcccagaagcgcccccgagcugcugaucuucgagaacaacagaagacccagcggcauccccgacagauucagcggcgccaagagcggcaccagcgccacccuggccaucaccggccugcagaccggcgacgaggccgacuacuucugcagcaccuggagcggcagccugaacuucggcaccggcaccagagugaccgugcug

SEQ ID NO: 33064 - RNA, 324 nt, Artificial Sequence
  derived and/or modified sequence opt4 from anti-HIV_119-022793_VR-Chain
cagagcgugcugacccagccccccagcgugagcgccgcccccggccagaaggugaccaucagcugcagcggcggcaccagcaacaucggcaacaacuacgugagcugguacagaagacugcccggcaccgcccccaagcugcugaucuacgagaacaacaagagacccagcggcauccccgacagauucagcggcgccaagagcggcaccagcgccacccugggcaucaccggccugcagaccggcgacgaggccgacuacuacugcgagaccugggacgacagcggcggcguguucggcaccggcaccaaggugaccgugcug

SEQ ID NO: 33065 - RNA, 324 nt, Artificial Sequence
  derived and/or modified sequence opt4 from anti-HIV_119-022395_VR-Chain
cagagcgugcugacccagccccccagcgugagcgccgcccccggccagaccgugaccaucagcugcagcggcagcaccagcaacaucggcaagaacgacgugagcugguaccagcagcugcccggcaccgcccccaagcugcugaucagcgacaacaacagaagacccagcuggacccccgacagauucagcggcagcaagagcggcaccagcgccacccuggccaucaccggccugcagaccggcgacgaggccgacuacuacugcgagaccugggacggcagcggcggcguguucggccccggcaccagagugaccgugcug

SEQ ID NO: 33066 - RNA, 333 nt, Artificial Sequence
  derived and/or modified sequence opt4 from anti-HIV_119-022334_VR-Chain
cagagcgugcugacccagccccccagcgugagcgccgcccccggccagaacgugaacaucagcugcagcggcggcagcagcaacaucggcagcaacuacgugagcugguaccagcaguuccccggcaccgcccccaagcaccugaucuacgagaacaacaagagacccagcggcauccccgacagauucagcgacagccagagcggcaccagcgccacccugggcaucaccggccugcagaccggcgacgaggccgacuacuacugcggcaccugggacggcagccugagaaccggcggcgugaucggcaccggcaccagagugaccgugcug

SEQ ID NO: 33067 - RNA, 321 nt, Artificial Sequence
  derived and/or modified sequence opt4 from anti-HIV_119-021866_VR-Chain
cagagcgugcugacccagccccccagcgugagcgccgcccccggccagagagugaccaucagcugcagcggcagcgccagcaacaucggcaagaacuucgugagcugguaccagcagcugcccggcaaggcccccaagcugaucaucuacgaggugaccaagagacccagcggcgugcccgccagauucagcggcagcaagagcggcaccagcgccacccuggccaucaccggccugcagaccggcgacgaggccgacuacuucugcagcaccuggagcggcagccugaacuucggcaccggcaccagagugaccgugcug

SEQ ID NO: 33068 - RNA, 324 nt, Artificial Sequence
  derived and/or modified sequence opt4 from anti-HIV_119-021278_VR-Chain
cagagcgugcugacccagccccccagcgugagcgccgcccccggccagaaggugaccaucagcugcagcggcagcgccagcaacaucggcaagaacuucgugagcugguaccagcagcugcccggcaccgcccccaagcugcugaucuacgagaacaacagaagacccagcggcacccccgacagauucagcggcagcagaagcggcaccagcgccacccugggcaucaccggccugcagaccggcgacgaggcccacuacuacugcgagaccugggacgacagcggcggcguguucggcaccggcaccaaggugaccgugcug

SEQ ID NO: 33069 - RNA, 333 nt, Artificial Sequence
  derived and/or modified sequence opt4 from anti-HIV_119-021183_VR-Chain
cagagcgugcugacccagccccccagcgugagcgccgcccccggccagaaggugaccaucagcugcagcggcaacagcagcaacaucggcaacaacuucgugagcugguaccagcaguuccccggcaccgcccccaagcugcugguguucgagacccacagaagacccagcggcauccccgacagauucagcggcagcaagagcggcaccagcgccacccuggccaucaccggccugcagaccggcgacgaggccgacuacuacugcgccguguggggcgugagaagaggcgugggcgccguguucggcgccggcaccaaggugaccgugcug

SEQ ID NO: 33070 - RNA, 333 nt, Artificial Sequence
  derived and/or modified sequence opt4 from anti-HIV_119-019376_VR-Chain
cagagcgugcugacccagccccccagcgugagcgccgcccccggccagaaggugaccaucagcugcagcggcagcagcagcaacaucggcaacaacuacgugagcugguaccagcaggugcccggcaccgcccccaagcugcugguguacgagaccuacagaagacccagcggcauccccgacagauucagcggcagcaagagcggcaccagcgccacccuggccaucaccggccugcagaccggcgacgaggccgacuacuacugcaccaucuggggcgugagaaagggcgugggcgccguguucggcaccggcaccaaggugaccgugcug

SEQ ID NO: 33071 - RNA, 321 nt, Artificial Sequence
  derived and/or modified sequence opt4 from anti-HIV_119-019238_VR-Chain
cagagcgugcugacccagccccccagcgugagcgccgcccccggccagaaggugaccaucagcugcagcggcaccagcagcaacaucggcaacaaccacgugagcugguaccagcaggugcccggcaccgcccccaagcugcugaucuacgagaacaacaagagacccagcggcauccccgccagauucagcgccgccaagagcggcaccagcgccacccuggccaucaccggccugcagaccggcgacgaggccgacuacuucugcgccaccuggagcggcagacugaacaucggcaccggcaccaaggugaccgugcug

SEQ ID NO: 33072 - RNA, 333 nt, Artificial Sequence
  derived and/or modified sequence opt4 from anti-HIV_119-018500_VR-Chain
cagagcgugcugacccagccccccagcgugagcgccgcccccggccagaaggugaacaucagcugcagcggcagcagcagcaacaucggcaacaacuucgugagcugguaccagcagagacccggcaccgcccccaagcugcugaucuacgagaccaacagaagacccagcggcauccccgacagauucagcggcagcaagagcggcaccagcgccacccuggccaucaccggccugcagaccggcgacgaggccgacuacuacugcgccaccugggccgccagccugaccagcgccagaguguucggcaucggcaccaaggugaccgugcug

SEQ ID NO: 33073 - RNA, 324 nt, Artificial Sequence
  derived and/or modified sequence opt4 from anti-HIV_119-018318_VR-Chain
cagagcgugcugacccagccccccagcgugagcgccgcccccggccagaccgugaucaucagcugcagcggcagcaccagcaacaucggcaagaacgacgugagcugguaccagcagcugcccggcaccgcccccaagcugcugaucagcgagaacaacagaagacccagcggcacccccgacagauucagcggcagcaagagcggcaccagcgccacccuggccaucaccggccugcagaccggcgacgacgccgacuacuacugcgagaccugggacggcagcggcggcguguucggcaccggcaccaaggugacccuggug

SEQ ID NO: 33074 - RNA, 333 nt, Artificial Sequence
  derived and/or modified sequence opt4 from anti-HIV_119-018218_VR-Chain
cagagcgugcugacccagccccccagcgugagcgccgcccccggccagaaggugaccaucagcugcagcggcaacagcagcaacaucggcaacaacuucgugagcugguaccagcagcugcccggcaccgcccccaagcugcugaucuacgagaacaacagaagacccagcggcauccccgacagauucagcggcagcaagagcggcaccagcgccacccuggccaucagcggccugcagaccggcgacgaggccgacuacuggugcgccguguggggcgugagaagaggcgccggcgccguguucggcgccggcaccaaggugaccgugcug

SEQ ID NO: 33075 - RNA, 324 nt, Artificial Sequence
  derived and/or modified sequence opt4 from anti-HIV_119-017876_VR-Chain
cagagcgugcugacccagccccccagcgugagcgccgcccccggccagaaggugaccaucagcugcagcggcagcaccagcaagaucggccagaacagcgugagcugguaccagcagcugcccggcaccgcccccaagcugcugaucuacgagaacgacagaagacccagcggcacccccgacagauucagcgccagcaagagcggcaccagcgccacccuggccaucaccggccugcagaccggcgacgaggccgacuacuacugcgagaccugggacgacagcggcggcguguucggcaccggcaccaaggugaccgugcug

SEQ ID NO: 33076 - RNA, 324 nt, Artificial Sequence
  derived and/or modified sequence opt4 from anti-HIV_119-017740_VR-Chain
cagagcgugcugacccagccccccagcgugagcgccgcccccggccagaaggugaccaucagcugcagcggcagcaacagcaacaucggcaacaaggacgugagcugguacagacaggugcccgccaccgcccccaagcugcccaucuacgagaacaagaacgagcccagcggcgugcccgacagauucagcggcagcaagagcggcaccagcgccacccuggccaucaccggccugcagaccggcgacgaggccgacuacuacugcgccaccugggacggcagagugagcgugaucggcaccggcaccaaggugaccguggug

SEQ ID NO: 33077 - RNA, 321 nt, Artificial Sequence
  derived and/or modified sequence opt4 from anti-HIV_119-017128_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaacaacaagagacccagcggcauccccgacagauucagcggcgccaagagcggcaccagcgccacccuggccaucaccggccugcagaccggcgacgaggccgacuacuucugcagcaccuggagcggcagccugaacuucggcaccggcaccagagugaccgugcug

SEQ ID NO: 33078 - RNA, 324 nt, Artificial Sequence
  derived and/or modified sequence opt4 from anti-HIV_119-017044_VR-Chain
cagagcgugcugacccagccccccagcgugagcgccgcccccggccagaaggugaccaucagcugcagcggcagcaacagcaacaucggcaacaacuacgugagcugguaccaccaccugcccggcaccgcccccagacugcugaucuacgacaacaacaagagacccagcggcauccccgacagauucagcggcagcaagagcggcaccagcgccacccuggccaucaccggccugcagaccggcgacgaggccgacuacuacugcgccaccugggacggcagagugagcgugaucggcaccggcacccaggugaccgugcug

SEQ ID NO: 33079 - RNA, 321 nt, Artificial Sequence
  derived and/or modified sequence opt4 from anti-HIV_119-016644_VR-Chain
cagagcgugcugacccagccccccagcgugagcgccgcccccggccagaaggugaccaucagcugcagcggcggcaccagcaacaucggcaacaacuacgugagcugguaccagcagcugcccggcaccgcccccaagcugcugaucuacgagaacaacaagagacccagcggcauccccgccagauucagcgccgccaagagcggcaccagcgccacccuggccaucaccggccugcagaccgaggacgaggccgacuacuacugcgccaccuggagcggcagccugaacaucggcaccggcaccaaggugaccgugcug

SEQ ID NO: 33080 - RNA, 333 nt, Artificial Sequence
  derived and/or modified sequence opt4 from anti-HIV_119-015878_VR-Chain
cagagcgcccugacccagccccccagcgccagcggcagccccggccagagcgugaccaucagcugcagcggcagcagcagcaacaucggcaacaacuucgugagcugguaccagcagagacccggcaccgcccccaagcugcugaucuacgagaccaacaagagacccagcggcauccccgacagauucagcggcagcaagagcggcaccagcgccacccuggccaucaccggccugcagaccggcgacgaggccgacuacuacugcgccaccugggcccccagacugaacagcgccagaguguucggcaacggcaccauggugaccgugcug

SEQ ID NO: 33081 - RNA, 321 nt, Artificial Sequence
  derived and/or modified sequence opt4 from anti-HIV_119-015538_VR-Chain
cagagcgugcugacccagccccccagcgugagcgccacccccggccagaaggugaccaucagcugcagcggcagcagcagcaacaucggcaacaacuacgugagcugguacagaagacugcccggcaccgcccccaagcaccugaucuacgagaccaacaacagacccagcggcgugcccgccagacugagcgccgccaagagcggcaccagcgccacccuggccaucaccggccugcagaccgaggacgaggccgacuacuacugcgccaccuggagcggcagccugaacaucggcaccggcaccaaggugaccgugcug

SEQ ID NO: 33082 - RNA, 321 nt, Artificial Sequence
  derived and/or modified sequence opt4 from anti-HIV_119-015455_VR-Chain
cagagcgugcugacccagccccccagcgugagcgccacccccggccagaaggugaccaucagcugcagcggcagcaacagcaacaucggcaacaaggacgugagcugguaccagcacuuccccggcaccgcccccaagcugcugaucuacgagaacaacaagagacccagcggcauccccgacagauucagcggcagcaagagcgccaccagcgccacccugaccaucaccggccugcagaccgaggacgaggccgacuacuacugcgccaccuggagcggcagccugaacaucggcaccggcaccaaggugaccgugcug

SEQ ID NO: 33083 - RNA, 321 nt, Artificial Sequence
  derived and/or modified sequence opt4 from anti-HIV_119-014425_VR-Chain
cagagcgugcugacccagccccccagcgugagcgccgcccccggccagaaggugaccaucagcugcagcggcggcaccagcaacaucggcaacaacuacgugagcugguaccagcaccugcccggcaccgcccccaagcugcugaucuacgagaacaacaagagacccagcggcauccccgacagauucagcggcgccaagagcggcaccagcgccacccuggccaucaccggccugcagaccggcgacgagggcgacuacuacugcgccaccuggagcggcagccugaacaucggcaccggcaccaaggugaccgugcug

SEQ ID NO: 33084 - RNA, 324 nt, Artificial Sequence
  derived and/or modified sequence opt4 from anti-HIV_119-013582_VR-Chain
cagagcauggugacccagagccccagcgugagcgccgcccccggccagaaggugaccaucagcugcagcggcaccagcagcaacaucggccagaacuacgugagcugguaccagcagcugcccggcaccgcccccaagcugcugaucagcgagaacaacagaagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 33085 - RNA, 333 nt, Artificial Sequence
  derived and/or modified sequence opt4 from anti-HIV_119-013364_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgacaacaacaagagacccagcggcauccccgacagauucagcggcagcaagagcggcaccagcgccacccuggccaucaccggccugcacaccggcgacgaggccgacuacuacugcaccguguggggcgugagaaagggcgugggcgccguguucggcaccggcaccaaggugaccgugcug

SEQ ID NO: 33086 - RNA, 333 nt, Artificial Sequence
  derived and/or modified sequence opt4 from anti-HIV_119-012886_VR-Chain
cagagcauccugacccagccccccagcgugagcgccgcccccggccagaaggugaccaucagcugcagcggcagcagcagcaccaucggcaccaacuacgugagcugguaccagcaguuccccggcaccgcccccaagcugcugguguucgagacccacagaagacccagcggcauccccgacagauucagcggcagcaagagcggcaccagcgccacccuggccaucaccggccugcagaccggcgacgaggccgacuacuacugcgccguguggggcgugagaagaggcgugggcgccguguucggcgccggcaccaaggugaccgugcug

SEQ ID NO: 33087 - RNA, 333 nt, Artificial Sequence
  derived and/or modified sequence opt4 from anti-HIV_119-012249_VR-Chain
cagagcgugcugacccagccccccagcgugagcggcgcccccggccagaaggugaccaucagcugcagcggcagcagcagcaacaucggcagaaacuacgugagcugguaccagcagcugcccggcaccgcccccaagcugcugaucuacgagaacaacaagagacccagcggcauccccgacagauucagcggcagcaagagcggcaccagcgccacccuggugaucaccggccugcagaccggcgacgaggccgacuucuacugcggcaccugggacggcagccugagcggcggcggcgugaucggcaccggcaccagagugaccgugcug

SEQ ID NO: 33088 - RNA, 324 nt, Artificial Sequence
  derived and/or modified sequence opt4 from anti-HIV_119-012161_VR-Chain
cagagcuuccugacccagccccccagcgugagcgccgcccccggccagaaggugaccaucagcugcagcggcagcaacagcaacaucggcaagaacuacgugagcugguaccaguaccugcccggcaccgugcccaagcugcugaucuacgagaacgacaagagacccagcggcauccccggcagauucagcgccagcaagagcggcaccagcgccacccuggccaucaccggccugcagaccggcgacgaggccgacuacuacugcggcaccugggacggcagcggcggcguguucggcaccggcaccaaggugaccgugcug

SEQ ID NO: 33089 - RNA, 324 nt, Artificial Sequence
  derived and/or modified sequence opt4 from anti-HIV_119-012110_VR-Chain
cagagcgugcugacccagccccccagcgugagcgccgcccccggccagaccgugaccaucagcugcagcggcagcaccagcaacaucggcaagaacgacgugagcugguaccagcagcugcccggcaccgcccccaagcugcugaucagcgagaacaacagaagacccagcggcacccccgacagauucagcggcagcaagagcggcaccagcgccacccuggccaucagcggccugcagaccggcgacgaggccgacuacuacugcggcaccugggacggcagcggcggcguguucggcaccggcaccaaggugaccgugcug

SEQ ID NO: 33090 - RNA, 333 nt, Artificial Sequence
  derived and/or modified sequence opt4 from anti-HIV_119-012100_VR-Chain
caggccgugcugacccagccccccagcgugagcgccgcccccggccagaagguggccaucagcugcagcggcagcagcagcaacaucggcaacaacuacgugagcugguaccagcagcugcccggcaccgugcccaagcugcugaucuacgacaccgacaagagacccagcggcauccccgacagauucagcggcagcaagagcggcaccagcgccacccugggcaucaccagacugcagaccggcgacgaggccgacuacuacugcgccaccugggcccccagacugaacagcgccagaguguucggcaacggcaccauggugaccgugcug

SEQ ID NO: 33091 - RNA, 324 nt, Artificial Sequence
  derived and/or modified sequence opt4 from anti-HIV_119-011651_VR-Chain
cagagcgugcugacccagccccccagcgugagcgccgcccccggccagaaggugaccaucagcugcagcggcaacagcagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccuggccaucaccggccugcagaccggcgacgaggccgacuacuacugcgccaccugggacggcagagugagcguguucggcaccggcaccaagguggccgugcug

SEQ ID NO: 33092 - RNA, 333 nt, Artificial Sequence
  derived and/or modified sequence opt4 from anti-HIV_119-011479_VR-Chain
cagagcgugcugacccagccccccagcgugagcgccacccccggccagaaggugaccaucagcugcagcggcagcaacagcaacaucggcaacaaguacgugagcugguaccagcacuuccccggcaccgcccccaagcugcugaucuacgagaacaacagaagacccagcggcauccccgacagauucagcggcagcaagagcggcaccagcgccacccuggccaucaccggccugcagaccggcgacgaggccgacuacuacugcaccaucuggggcgugagaaagggcgugggcgccguguucggcaccggcaccaaggugaccgugcug

SEQ ID NO: 33093 - RNA, 333 nt, Artificial Sequence
  derived and/or modified sequence opt4 from anti-HIV_119-011232_VR-Chain
cagagcgugcugacccagccccccagcgugagcgccgcccccggccagaacgugaacaucagcugcagcggcggcagcagcaacaucggcagcaacuacgugagcugguaccagcaguuccccggcaccgcccccaagcugcugaucuacgacgacgacaagagacccagcggcaucccccacagauucagcgccagcaagagcggcaccagcgccacccuggccaucagcggccugcagaccggcgacgaggccgacuacugcugcgccguguggggcgugagaagaggcgccggcgccguguucggcgccggcaccaaggugaccgugcug

SEQ ID NO: 33094 - RNA, 333 nt, Artificial Sequence
  derived and/or modified sequence opt4 from anti-HIV_119-011175_VR-Chain
cagagcgugcugacccagccccccagcgugagcgccgcccccggccagaaggugaccaucagcugcagcggcagcaacagcuacaucggcaacaaguacgugagcugguaccagcaguuccccggcaccgcccccaagcugcugaucuacgagaacaacagaagacccagcggcauccccgacagauucagcggcagcaagagcggcaccagcgccacccuggccaucagcggccugcagaccggcgacgaggccgacuacugcugcgccguguggggcgugagaagaggcgccggcgccguguucggccccggcaccaaggugaccgugcug

SEQ ID NO: 33095 - RNA, 321 nt, Artificial Sequence
  derived and/or modified sequence opt4 from anti-HIV_119-008396_VR-Chain
cagagcgugcugacccagccccccagcgugagcgccgcccccggccagaaggugaccaucagcugcagcggcagcagcagcaacaucggcaacaacuacgugagcugguaccagcaggugcccggcaccgcccccaagcugcugguguacgagaacaccagaagacccagcggcgugcccgacagauucagcggcgccaagagcggcaccagcgccacccuggccaucaccggccugcagaccggcgacgagggcgacuacuacugcgccaccuggagcggcagccugaacaucggcaccggcaccaaggugaccgugcug

SEQ ID NO: 33096 - RNA, 324 nt, Artificial Sequence
  derived and/or modified sequence opt4 from anti-HIV_119-007148_VR-Chain
cagagcgugcugacccagccccccagcgugagcgccgcccccggccagaaggugaccaucagcugcagcggcagcaccagcaacaucggcaagaacuacgugagcugguaccagcaccugcccggcaccgcccccaagcugcugcuguacgagaacgacagaagacccagcggcacccccgacagauucagcggcagcaagagcggcaccagcgccacccuggccaucaccggccugcacaccggcgacgaggccgacuacuacugcgagaccugggacggcagcggcggcguguucggcaccggcaccaaggugaccgugcug

SEQ ID NO: 33097 - RNA, 333 nt, Artificial Sequence
  derived and/or modified sequence opt4 from anti-HIV_119-007029_VR-Chain
cagagcgugcugacccagccccccagcgugagcgccgcccccggccagaaggugaccaucagcugcagcggcaacagcagcaacaucggcaacaacuucgugagcugguaccagcaggugcccggcaccgcccccaagcugcugcuguacgagaccuacagaagacccagcggcaucagcgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 33098 - RNA, 324 nt, Artificial Sequence
  derived and/or modified sequence opt4 from anti-HIV_119-004707_VR-Chain
cagagcgugcugacccagccccccagcgugagcgccgcccccggccagaaggugaccaucagcugcagcggcagcaccagcaacaucggcaagaacgacgugagcugguaccagcagcugcccggcaccgcccccaagcugcugaucagcgagaacaacagaagacccagcggcacccccgacagauucagcggcagcaagagcggcaccagcgccacccuggccaucaccggccugcagaccggcgacgaggccgacuacuacugcgagaccugggacggcagcggcggcguguucggcaccggcaccaaggugaccgugcug

SEQ ID NO: 33099 - RNA, 333 nt, Artificial Sequence
  derived and/or modified sequence opt4 from anti-HIV_119-003910_VR-Chain
cagagcgugcugacccagccccccagcgugagcgccgcccccggccagaagguggccaucagcugcagcggcaacaccagcagcaucggcaacaacuucgugagcugguaccagcaggugcccggcaccgcccccaagcugcugguguacgagaccuacagaagacccagcggcauccccgacagauucagcggcagcaagagcggcaccagcgccacccuggccaucaccggccugcagaccggcgacgaggccgacuacuacugcaccguguggggcgugagaaagggcgugggcgccguguucggcaccggcaccaaggugaccgugcug

SEQ ID NO: 33100 - RNA, 321 nt, Artificial Sequence
  derived and/or modified sequence opt4 from anti-HIV_119-002450_VR-Chain
cagagcgugcugacccagccccccagcgugagcggcgcccccggccagagagugaccaucagcugcaccggcagcagcagcaacaucggcaacaacuacgugagcugguaccagggccugcccggcaccgcccccaagcugcugaucuacgagaacaacaagagacccagcggcauccccgacagauucagcggcgccaagagcggcaccgccgccacccuggccaucaccggccugcagaccggcgacgaggccgacuacuacugcgccaccuggagcggcagccugaacuucggcaccggcaccaaggugaccgugcug

SEQ ID NO: 33101 - RNA, 321 nt, Artificial Sequence
  derived and/or modified sequence opt4 from anti-HIV_119-001552_VR-Chain
cagagcgugcugacccagccccccagcgugagcgccgcccccggccagaaggugaccaucagcugcagcggcagcaacagcuaccugggcaacaaguacgugagcugguaccagcaguuccccggcaccgcccccaagcugcugaucuacgagaacaacaagagacccagcggcauccccgacagauucagcgccagcaagagcgccgccagcgccacccuggccaucaccggccugcagaccggcgacgagggcgacuacuacugcgccaccuggaccggcagccugaacaucggcaccggcaccaaggugaccgugcug

SEQ ID NO: 33102 - RNA, 333 nt, Artificial Sequence
  derived and/or modified sequence opt4 from anti-HIV_059-188169_VR-Chain
cagagcgugcugacccagccccccagcgugagcgccgcccccggccagaaggugaccaucagcugcagcggcagcaccagcaacaucggcgacaacuacgugagcugguaccagcaggugcccggcaccgcccccaagcugcugaucuacgagaacaacagaagacccagcggcacccccgacagauucagcggcagcaagagcggcaccagcgccacccuggccaucaccggccugcagaccggcgacgaggccgacuacuacugcggcaccugggacaccagccugagcaccggcggcguguucggcaccggcaccaaggugaccgugcug

SEQ ID NO: 33103 - RNA, 333 nt, Artificial Sequence
  derived and/or modified sequence opt4 from anti-HIV_059-183739_VR-Chain
cagagcgugcugacccagccccccagcgugagcgccgcccccggccagaaggugaccaucagcugcagcggcagcaccagcaacaucggcaagaacuacgugagcugguaccagcagcugcccggcaccgcccccaagcugcugaucuacgagaacaacagaagacccagcggcacccccgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 33104 - RNA, 333 nt, Artificial Sequence
  derived and/or modified sequence opt4 from anti-HIV_059-182376_VR-Chain
cagagcgugcugagccagccccccagcgugagcgccgcccccggccagaaggugaccaucagcugcagcggcagcagcagcaacaucggcaacuacuacgugagcugguaccagcaguuccccggcaccgcccccaagcugcugaucuacaagaacgacaacagacccagcggcauccccgacagauucagcggcagcaagagcggcaccagcgccacccugggcaucagcggccugcagaccggcgacgaggccgacuacuacugcggcaccuggggcaccagccugagcggcggcggcguguucggcaccggcaccaaggugaccgugcug

SEQ ID NO: 33105 - RNA, 333 nt, Artificial Sequence
  derived and/or modified sequence opt4 from anti-HIV_059-182199_VR-Chain
cagagcgugcugacccagccccccagcgugagcgccgcccccggccagaacaucaccaucagcugcagcggcagcagcagcaacaucggcagccacagcaucagcugguaccagcaccugcccggcaccgcccccaagaucgugaucuacgacaacgacaagagaccccugggcauccccgacagauucagcggcagcaagagcggcaccagcgccacccugggcaucaccggccugcagaccggcgacgaggccgacuacuacugcggcaccugggacaccagccugagcggcggcggcguguucggccccggcaccaaggugaccgugcug

SEQ ID NO: 33106 - RNA, 324 nt, Artificial Sequence
  derived and/or modified sequence opt4 from anti-HIV_059-169202_VR-Chain
cacagcgugcugacccagccccccagcgugagcgccgcccccggccagaaggugaccaucagcugcagcggcagcagcagcaagaucggcaacaacuucgugagcugguaccagcagcugcccggcaccgcccccaagcugcugaucuacgagaacaacaagagacccagcggcauccccgacagauucagcggcagcaagagcggcaccagcgccacccuggccaucaccggccugcagaccggcgacgaggccgacuacuacugcggcaccugggacggcagagugagcgugaucggcagcggcaccaagcugaccgugcug

SEQ ID NO: 33107 - RNA, 324 nt, Artificial Sequence
  derived and/or modified sequence opt4 from anti-HIV_059-155645_VR-Chain
cagagcgcccugacccagcccgccagcgugagcggcagccccggccagagcaucaccaucagcugcaccggcaccagcagcgacgugggcuacaacuacgugagcugguaccagcagcugcccggcaccgcccccaagcugcugaucuacgagaacaacaagagacccagcggcauccccgacagauucagcggcagcaagagcggcaccagcgccacccuggccaucaccggccugcagaccggcgacgaggccgacuacuacugcggcaccugggacggcagacugagcgugaucggcaccggcaccaaggugaccgugcug

SEQ ID NO: 33108 - RNA, 333 nt, Artificial Sequence
  derived and/or modified sequence opt4 from anti-HIV_059-151619_VR-Chain
cagagcgugcugacccagccccccagcgugagcgccgcccccggccagaaggugaccaucagcugcagcggcagcagcagcaacaucggcaacaacuucgugagcugguaccagcugcugcccggcaccccccccaagcugcugaucuucaagaacaacgagagacccagcggcauccccgacagauucagcggcagcaagagcggcaccagcgccacccugggcaucaccggccugcagaccggcgacgagggcgacuacuacugcggcaccugggacaccagccugagcggcggcggcguguucggcaccggcaccagagugaccgugcug

SEQ ID NO: 33109 - RNA, 333 nt, Artificial Sequence
  derived and/or modified sequence opt4 from anti-HIV_059-146503_VR-Chain
cagagcgugcugacccagccccccagcgugagcgccacccccggccagaaggugaccaucagcugcagcggcagcgccagcaacaucggcaacaacuacgugagcugguaccagcaguuccccggcaccgcccccaagcugcugaucuacgacaccaacaagagacccagcggcauccccgacagauucagcggcagcaagagcggcaccagcgccauccugggcaucaccggccugcagaucggcgacgaggccgacuacuacugcggcaccugggacaccagccugagcggcggcggcguguucggcaccggcaccaaggugaccgugcug

SEQ ID NO: 33110 - RNA, 324 nt, Artificial Sequence
  derived and/or modified sequence opt4 from anti-HIV_059-136098_VR-Chain
cagagcgugcugacccagccccccagcgugagcgccgcccccggccagagagugaccaucagcugcagcggcagcagcagcaacaucggcaacaacuacgugagcugguaccagcagcugcccggcaccgcccccaagcugcugaucuacgagaacaacagaagacccagcggcauccccgacagauucagcggcagcaagagcggcaccagcgccacccuggccaucaccggccugcagaccggcgacgagggcgacuacuacugcgccagaugggacggcagacugagcgugaucggcagcggcaccaaggugaccgugcug

SEQ ID NO: 33111 - RNA, 333 nt, Artificial Sequence
  derived and/or modified sequence opt4 from anti-HIV_059-105516_VR-Chain
cagagcgcccugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgacaacaacaagagacccagcggcauccccgacagauucagcggcagcaagagcggcaccagcgccacccuggccaucgccggccugcagaccggcgacgaggccaacuacuacugcggcaccugggacggcagccugagaaccggcggcguguucggcaccggcaccaaggugaccgugcug

SEQ ID NO: 33112 - RNA, 333 nt, Artificial Sequence
  derived and/or modified sequence opt4 from anti-HIV_059-095709_VR-Chain
cagagcgugcugacccagccccccagcgugagcgccgcccccggccagaaggugaccaucagcugcagcggcagaagcagcaacaucggcaacaacuucgugagcugguaccagcugcugcccggcaccgcccccaagcugcugaucuacaagaacaacgagagacccagcggcauccccgacagauucagcgccagcaagagcggcaccagcgccacccugggcaucaccggccugcagaccggcgacgaggccgacuacuacugcggcaccugggacaccagccugagcggcggcggcguguucggcaccggcaccaaggugaccgugcug

SEQ ID NO: 33113 - RNA, 333 nt, Artificial Sequence
  derived and/or modified sequence opt4 from anti-HIV_059-069468_VR-Chain
cagagcgugcugacccagccccccagcgugagcggcgcccccagacagagcgugaucaucagcugcaccggcagcagcagcaacaucggcggcuucgacgugcacugguaccagcagcugcccggcaccgcccccaagcugcugaucuacgagaacaacagaagacccagcggcacccccgacagauucagcggcagcaagagcggcaccagcgccacccuggccaucaccggccugcagaccggcgacgaggccgacuacuacugcggcaccugggacggcagccugagcaccggcggcgugaucggcaccggcaccaaggugaccgugcug

SEQ ID NO: 33114 - RNA, 333 nt, Artificial Sequence
  derived and/or modified sequence opt4 from anti-HIV_059-060026_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgugcccaagcugcugaucuacaagaacgacaagagacccagcggcauccccgacagauucagcggcagcaagagcgccaccagcgccacccugggcaucaccggccugcagaccggcgacgaggccgacuacuacugcggcaucugggacaccagccugagcgccggcggcguguucggcaccggcaccagagugaccgugcug

SEQ ID NO: 33115 - RNA, 333 nt, Artificial Sequence
  derived and/or modified sequence opt4 from anti-HIV_059-053668_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaacaacaagagaagcagcggcauccccgacagauucagcggcagcaagagcggcaccagcgccacccuggccaucaccggccugcagaccggcgacgaggccgacuacuacugcggcaccagagacagcagccugagcggcggcggcgugaucggcaccggcaccaaggugaccgugcug

SEQ ID NO: 33116 - RNA, 333 nt, Artificial Sequence
  derived and/or modified sequence opt4 from anti-HIV_059-052864_VR-Chain
cagagcgugcugacccagccccccagccugagcgccgcccccggccagagagugaccaucagcugcagcggcagcagcagcaacaucggcaacaacuacgugagcugguaccagcagcugcccggcaccgcccccaagcugcugaucuacgagagcaacaagagacccagcggcacccccgacagauucagcggcagcaagagcggcaccagcgccacccuggccaucaccggccugcagaccggcgacgaggccgacuacuacugcggcaccugggacgccagccugagcagcggcggcgugaugggcaccggcaccaaggugaccgugcug

SEQ ID NO: 33117 - RNA, 333 nt, Artificial Sequence
  derived and/or modified sequence opt4 from anti-HIV_059-050968_VR-Chain
cagagcgugcugacccaggcccccagcgugagcgccgcccccggcgagaaggugaccaucagcugcagcggcaccagcagcaacaucggcuacuacuacgugagcugguaccagcaguuccccggcaccgcccccaagguggugaucuacgagaacaacagaagacccagcggcacccccgacagauucagcggcagcaagagcggcaccagcgccacccuggccaucaccggccugcagaccggcgacgaggccgacuacuacugcggcaccuggggcggcagccugagcaccggcggcgugaucggcaccggcaccaaggugaccgugcug

SEQ ID NO: 33118 - RNA, 333 nt, Artificial Sequence
  derived and/or modified sequence opt4 from anti-HIV_059-046422_VR-Chain
cagagcgugcugacccagccccccagcgugagcgccgcccccggccagaaggugaccaucagcugcagcggcagcagcagcaccaucggcaacaacuacaucagcugguaccagcugcugcccggcaccccccccaacuaccugaucuucaagaucagcgagagacccagcggcgugcccgacagauucagcggcagcaagagcggcaccagcgccacccugcacaucaccggccugcagaccggcgacgagggcgacuacuacugcggcaccugggacaccagccugagcggcggcggcguguucggcaccggcaccaaggugaccgugcug

SEQ ID NO: 33119 - RNA, 333 nt, Artificial Sequence
  derived and/or modified sequence opt4 from anti-HIV_059-045120_VR-Chain
cagagcgugcugacccagccccccagcgugagcgccgcccccggccagaagguggccaucagcugcagcggcagcagcagcaccaucggcaacaacuacgugagcugguaccagcugcugcccggcaccccccccaagcugcugaucuucaagagccacgagagacccagcggcauccccgacagauucagcggcagcaagagcggcaccagcgccacccugggcaucaccggccugcagaccggcgacgagggcgacuacuacugcggcaccugggacagcagccugagcgugggcggcguguucggcaccggcaccaaggugaccgugcug

SEQ ID NO: 33120 - RNA, 333 nt, Artificial Sequence
  derived and/or modified sequence opt4 from anti-HIV_059-039932_VR-Chain
cagagcgugcugacccagccccccagcgugagcgccgcccccggccagaaggugaccaucagcugcagcggcagcagcagcaucaucggcaagaacuacgugagcugguaccagcaccugcccggcaccgcccccaagcugcugaucuacgagaacaacaagagacccagcggcauccccgacagauucagcggcagcaagagcggcaccagcgccacccuggccaucgccggccugcagaccggcgacgaggccaacuacuacugcggcaccuggggcggcagccugagcaccggcggcguguucggcaccggcaccaaggugaccgugcug

SEQ ID NO: 33121 - RNA, 333 nt, Artificial Sequence
  derived and/or modified sequence opt4 from anti-HIV_059-038595_VR-Chain
cagagcgugcugacccagccccccagcgugagcgccgcccccggccagaaggugaccaucagcugcagcggcagaagcagcaacaucggcaacaacuucgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaucgugcug

SEQ ID NO: 33122 - RNA, 333 nt, Artificial Sequence
  derived and/or modified sequence opt4 from anti-HIV_059-035082_VR-Chain
cagagcgugcugacccagccccccagcgugagcgccgcccccggccagaaggugaccaucagcugcagcggcagcaccagcaacaucggcaagagcuucgugagcugguaccagcagcugcccggcaccgcccccaagcugcugaucuacgacaacaacagaagacccagcggcacccccgacagauucagcggcagcaagagcggcaccagcgccacccuggccaucaccggccugcagaccggcgacgaggccgacuacuacugcggcaccuggggcggcagccugagcaccggcggcgugaucggcaccggcaccaaggugaccgugcug

SEQ ID NO: 33123 - RNA, 333 nt, Artificial Sequence
  derived and/or modified sequence opt4 from anti-HIV_059-029204_VR-Chain
cagagcgugcugacccagccccccagcgugagcgccgcccccggccagaaggugaccaucagcugcagcggcagcaccagcaacaucggcaagauccuggugagcugguaccagcagcugcccggcaccgcccccaagcccagcaucuacgacaacaacagaagacccagcggcacccccgacagauucagcggcagcaagagcggcaccagcgccacccuggccaucaccggccugcagaccggcgacgaggccgacuacuacugcggcaccugggacggcagccugagcaccggcggcgugaucggcaccggcaccaaggugaccgugccc

SEQ ID NO: 33124 - RNA, 324 nt, Artificial Sequence
  derived and/or modified sequence opt4 from anti-HIV_059-025235_VR-Chain
cagagcgugcugacccagccccccagcgugagcggcgcccccggccagaagaucaccaucagcugcagcggcagcaccagcaacaucggcaagagcuacgugagcugguaccagcagcugcccggcaccgcccccaagcugcugaucuacgagaacaacagaagacccagcggcacccccgacagauucagcggcagcaagagcggcaccagcgccacccuggccaucaccggccugcagaccggcgacgaggccgacuacuacugcggcaccugggacggcagcggcggcgugaucggcaccggcaccaaggugaccgugcug

SEQ ID NO: 33125 - RNA, 333 nt, Artificial Sequence
  derived and/or modified sequence opt4 from anti-HIV_059-015192_VR-Chain
cagagcgugcugacccagccccccagcgugagcgccgcccccggccagaaggugaccaucagcugcagcggcagcagcagcaccaucggcgacaaguacgugagcugguaccagcugcugcccggcaccgcccccaagcugcugaucuacaagaacaacaagagacccagcggcauccccgacagauucagcggcagcaagagcggcaccagcgccacccugggcaucaccggccugcagaccggcgacgaggccgacuacuacugcggcaccugggacaccagccugagcgugggcggcguguucggcaccggcaccaaggugaccgugcug

SEQ ID NO: 33126 - RNA, 333 nt, Artificial Sequence
  derived and/or modified sequence opt4 from anti-HIV_059-007060_VR-Chain
cagagcgugcugacccagccccccagcgugagcgccgcccccggccagaaggugaccaucagcugcagcggcagcagcagcaacaucggcaacaaguacgugagcugguaccagcagcugcccggcaccgcccccaagcugcugaucuacgagaacaagaagagacccagcggcauccccgacagauucagcggcagcaagagcggcaccagcgccacccugggcaucaccggccugcagaccggcgacgaggccgacuacuucugcggcaccugggacaccagccugagcggcggcggcguguucggcagcggcaccaaggugaccgugcug

SEQ ID NO: 33127 - RNA, 324 nt, Artificial Sequence
  derived and/or modified sequence opt4 from anti-HIV_059-006953_VR-Chain
cagagcgugcugacccagccccccagcgugagcgccgcccccggccagaaggugaccaucagcugcagcggcagcagcagcaacaucggcgugagcugguaccagcaggugcccggcaccgcccccaagcugcugaucuacgacaacgacaagagacccaccggcauccccgacagauucagcggcagcaagagcggcaccagcgccauccuggccaucaccggccugcagaccggcgacgagggcgacuacuacugcggcaccugggagaccagccugagcggcggcggcguguucggcaccggcaccaaggugaccgugcug

SEQ ID NO: 33128 - RNA, 333 nt, Artificial Sequence
  derived and/or modified sequence opt4 from anti-HIV_059-005953_VR-Chain
cacagcgugcugacccagccccccagcgugagcgccgcccccggccagaaggugaccaucagcugcagcggcaccagcagcaacaucggcaagaacuacgugagcugguaccagcagcugcccggcaccgcccccaagcugcugaucuacgagaacaacagaagacccagcggcacccccgacagauucagcggcagcaagagcggcaccagcgccacccuggccaucaccggccugcagaccggcgacgaggccgacuacuacugcggcaccugggacaccagccugagcaccggcggcguguucggcaccggcaccaaggugaccgugcug

SEQ ID NO: 33129 - RNA, 324 nt, Artificial Sequence
  derived and/or modified sequence opt4 from anti-HIV_059-003725_VR-Chain
cagagcgugcugacccagccccccagcgugagcgccgcccccggccagaagcugaccaucagcugcagcggcagcaccagcaagaucggcaacaacuacgugagcugguaccagcaccugcccggcaccgcccccaagcugcugguguacgagaacaacaagagacccagcggcauccccgacagauucagcggcagcaagagcggcaccagcgccacccuggccaucaccggccugcagaccggcgacgaggccgacuacuacugcggcaccugggacggcagacugagcgugaucggcaccggcaccaaggugaccgugcug

SEQ ID NO: 33130 - RNA, 333 nt, Artificial Sequence
  derived and/or modified sequence opt4 from anti-HIV_059-002618_VR-Chain
cagcuggugcugacccagccccccagcgugagcgccgcccccggccagaaggugaccaucagcugcagcggcagcagcagcaacaucggcaacaacuucgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaccagacugagcgccggcggcguguucggcaccggcaccaaggugaccgugcug

SEQ ID NO: 33131 - RNA, 324 nt, Artificial Sequence
  derived and/or modified sequence opt4 from anti-HIV_059-001522_VR-Chain
cagagcgugcugacccagccccccagcgugagcgccgcccccggccagaaggugaccaucagcugcagcggcagcaacagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccuggccaucaccggccugcagaccggcgacgaggccgacuacuacugcggcaccugggacggcagacugagcgugaucggcgccggcaccaaggugaucguggug

SEQ ID NO: 33132 - RNA, 333 nt, Artificial Sequence
  derived and/or modified sequence opt4 from anti-HIV_059-000731_VR-Chain
cagagcgugcugacccagccccccagcgugagcgccgcccccggccagaaggugaccaucagcugcagcggcagcaccagcaacaucggcaacaaguacgugagcugguaccagcaggugcccggcaccgcccccaagcugcugaucuacgagaacaacagaagacccagcggcauccccgacagauucagcggcagcaagagcggcaccagcgccacccuggccaucaccggccugcagaccggcgacgaggccgacuacuacugcggcaccugggacgccagccugagaaccggcggcgugaucggcaccggcaccaaggugaccgugcug

SEQ ID NO: 33133 - RNA, 333 nt, Artificial Sequence
  derived and/or modified sequence opt4 from anti-HIV_059-000634_VR-Chain
cagagcgugcugacccagccccccagcgugagcgccgcccccggccagaaggugaccaucagcugcagcggcagcagcagcaccaucggcaacaacuacgugagcugguaccagguggugcccggcaccgcccccaagcugcugaucuacaagaucaacgagagacccagcggcauccccgacagauucagcggcagcaagagcggcaccagcgccacccugggcaucaccggccugcagaccggcgacgaggccgacuacuacugcggcaccugggacaccagccugagcggcggcggcguguucggccccggcaccaaggugaccgugcug

SEQ ID NO: 33134 - RNA, 333 nt, Artificial Sequence
  derived and/or modified sequence opt4 from anti-HIV_048-250757_VR-Chain
cagagcgugcugacccagccccccagcgugagcggcgcccccggccagagagugaccaucagcugcaccggcaccaccagcaacaucggcagcaacuacguggccugguaccagcagcugcccggcaccgcccccaagcugcugaucuacgacaacgacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33135 - RNA, 333 nt, Artificial Sequence
  derived and/or modified sequence opt4 from anti-HIV_048-250716_VR-Chain
cagagcgugcugacccagccccccagcgugagcgccgcccccggccagaaggugaccaucagcugcagcggcagcagcagcaacaucggcaacaaguacgugagcugguaccagcagcugcccggcaccgcccccaagcugcugaucuacgagaacagcaagagacccagcggcauccccgacagauucagcggcagcaagagcggcaccagcgccacccugggcaucaccggccugcagaccggcggccaggccgacuacuacugcggcaccugggacaccagccugagcgccggcggcguguucggcagcggcaccaaggugaccgugcug

SEQ ID NO: 33136 - RNA, 333 nt, Artificial Sequence
  derived and/or modified sequence opt4 from anti-HIV_048-250463_VR-Chain
cagagcgugcugacccagccccccagcgugagcgccgcccccggccagaaggugaccaucagcugcagcggcagcagaagcaacaacggcaacaacuacgugagcugguaccagcagcugcccggcaccgcccccaagcugcugaucuacgagaacaacaagagacccagcggcauccccgacagauucagcggcagcaagagcggcaccagcgccacccuggccaucaccggccugcagaccggcgacgaggccgacuacuacugcggcaccugggacagcagccugagcggcggcggcgugaucggcaccggcaccaagcugaccgugcug

SEQ ID NO: 33137 - RNA, 333 nt, Artificial Sequence
  derived and/or modified sequence opt4 from anti-HIV_048-248153_VR-Chain
cagagcgcccugacccagcccgccagcgugagcgccagcuucggccagagcaucaccaucagcugcaccggcgccgccagcgacgugggcuacaacuacgugagcugguaccagcagcugcccggcaccacccccaagcugcugaucuacagaaacaaccagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33138 - RNA, 333 nt, Artificial Sequence
  derived and/or modified sequence opt4 from anti-HIV_048-247532_VR-Chain
cagagcgugcugacccagccccccagcgugagcgccgcccccggccagcaggugaccaucagcugcagcggcaccaccagcaacaucggcaccaacuacgugagcugguaccagcagaugccccccgccgcccccaagcugcugaucuacgacaacaagaagagacccagcgacauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33139 - RNA, 333 nt, Artificial Sequence
  derived and/or modified sequence opt4 from anti-HIV_048-245846_VR-Chain
cagagcgugcugacccagccccccagcgugagcgccacccccggccagagagugaccaucagcugcaccggcagcagcagcaacaucggcggcuacgacgugagcugguaccaggugcugcccggcaccgcccccaagcugcugaucuacgacagcgacaagagacccagcggcauccccgacagauucagcggcagccagagcggcaccagcgccacccugggcaucaccggccugcagaccggcgacgaggccgacuacuacugcggcaccugggacaccagccugagcggcggcggcguguucggcaccggcaccaaggugaccgugcug

SEQ ID NO: 33140 - RNA, 333 nt, Artificial Sequence
  derived and/or modified sequence opt4 from anti-HIV_048-244016_VR-Chain
cagagcgugcugacccagccccccagcgugagcggcgcccccggccagagagugaccaucagcugcaccggcagcagcagcaacaucggcggcuacgacgugcacugguaccagcagcugcccggcaccgcccccaagcugcugaucuacaagaacgacaagagacccagcggcauccccgacagauucagcggcagcaagagcggcaccagcgccauccugggcaucaccggccugcagaccggcgacgaggccgacuacuacugcggcgccugggacaccagccugagcgccggcggcguguucggcaccggcaccaaggugaccgugcug

SEQ ID NO: 33141 - RNA, 333 nt, Artificial Sequence
  derived and/or modified sequence opt4 from anti-HIV_048-243682_VR-Chain
cagagccugcugacccagccccccagcgugagcgccgcccccggccagaaggugaccaucagcugcaccggcagcagcagcaacaucggcggcuacgacgugcacugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33142 - RNA, 333 nt, Artificial Sequence
  derived and/or modified sequence opt4 from anti-HIV_048-243588_VR-Chain
cagagccugcugacccagccccccagcgugagcgccccccccggccagauggugagcaucagcugcagcggcagcagccacaacaucggcgacaacuacgugagcugguaccagcaccugcccggcaccgcccccaagcugcugaucuacgacaacaacagcagacccagcggcauccccgacagauucagcggcagcaagagcggcaccagcgccacccugggcaucaccggccugcagaccggcgacgaggccgacuacuacugcggcaccugggacaccagccugagcggcggcggcguguucggcaccggcaccaaggugaccgugcug

SEQ ID NO: 33143 - RNA, 333 nt, Artificial Sequence
  derived and/or modified sequence opt4 from anti-HIV_048-241775_VR-Chain
cagagcgugcuggcccagccccccagcgugagcggcgcccccggccagagagugaccaucagcugcaccggcagcagcagcaacaucggcgaguacgacgugcacugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33144 - RNA, 333 nt, Artificial Sequence
  derived and/or modified sequence opt4 from anti-HIV_048-237996_VR-Chain
cagagcgugcugacccagccccccagcgugagcggcgcccccggccagagagugaccaucagcugcaccggcagcagcagcaacaucggcggcuacgacgugcacugguacagacagcugcccggcaccgcccccaagcugcugaucuacgacaccgugaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33145 - RNA, 330 nt, Artificial Sequence
  derived and/or modified sequence opt4 from anti-HIV_048-237730_VR-Chain
agcgugcugacccagccccccagcgugagcggcgcccccggccagagagugaccaucagcugcaccggcaccaacagcaacuucggcagcaacuacgcccacugguaccagcaggugcccggcaccgcccccaagcugcugaucuacagcaacaacgccagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33146 - RNA, 333 nt, Artificial Sequence
  derived and/or modified sequence opt4 from anti-HIV_048-237253_VR-Chain
cagagcgugcugacccagccccccagcgugagcgccgcccccggccagaaggugaccgugagcugcagcggcagcagcagcaacaucggcagcaacgacgugagcugguaccagcaguuccccggcgccgcccccaagcugcugaucuacaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33147 - RNA, 333 nt, Artificial Sequence
  derived and/or modified sequence opt4 from anti-HIV_048-234100_VR-Chain
cagagcaugcugacccagccccccagcgugagcgccgcccccggcgagaaggugaccaucagcugcagcggcagcagcagcaacaucggcaagaccuucgugagcugguaccagcaggugcccggcaccgcccccaagcugcugaucuacaagaacgacaacagacccagcggcauccccgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 33148 - RNA, 333 nt, Artificial Sequence
  derived and/or modified sequence opt4 from anti-HIV_048-230882_VR-Chain
cagagcgugcugacccagccccccagcgugagcgccgcccccggccagaaggugaccaucagcugcagcggcaacagcagcaacaucggcagcaacuucgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaccagccugagccccggcggcguguucggcaccggcaccaaggugaccgugcug

SEQ ID NO: 33149 - RNA, 333 nt, Artificial Sequence
  derived and/or modified sequence opt4 from anti-HIV_048-229473_VR-Chain
cagagcgugcugacccagccccccagcgugagcgccgcccccggccagaaggugaccaucagcugcagcggcagcagcagcaacaucggcaacaacuacgugagcugguaccagcaguuccccggcaccgcccccaagcugcugaucuacgagaacaacaagagacccagcggcauccccgacagauucagcggcagcaagagcggcaccaccgccacccuggccaucaccagacugcagaccggcgacgaggccgacuacuacugcggcaccuggggcggcagccugagcgccggcggcguguucggcaccggcaccaaggugaccgugcug

SEQ ID NO: 33150 - RNA, 333 nt, Artificial Sequence
  derived and/or modified sequence opt4 from anti-HIV_048-228238_VR-Chain
cagagcgugcugacccagccccccagcgugagcgccgcccccggccagaaggugaccaucagcugcagcggcagcagcagcaacaucggcaucaacuacgugagcugguaccagcagcugcccggcaccgcccccaagcugcugaucuacgacaacaccaagagaccccagggcauccccgacagauucagcggcagcaagagcggcaccagcgccacccuggccaucaccggccugcagaccggcgacgaggccgacuacuacugcggcaccugggacggcagccugagcaccggcggcgugaucggcaccggcaccaaggugaccgugcug

SEQ ID NO: 33151 - RNA, 333 nt, Artificial Sequence
  derived and/or modified sequence opt4 from anti-HIV_048-228027_VR-Chain
cagagccugcugacccagagccccagcgccagcggcccccccggccagagagugaccaucagcugcagcggcagcaacagcaacaucggcagcaacaccgugaacugguaccaccaccugcccggcgccgcccccaagcugcugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33152 - RNA, 333 nt, Artificial Sequence
  derived and/or modified sequence opt4 from anti-HIV_048-227795_VR-Chain
cagagcgugcugacccagccccccagcgugagcgccgcccccggccagaaggugaccaucagcugcagcggcagcagcagcaacaucgagagcagaagcgugcacugguaccagcagaagcccggccaggcccccgugcuggugaucuacuacgacagcgacagacccagcggcauccccgacagauucagcggcagcaagagcggcaccgccgccacccugggcaucaccggccugcagaccggcgacgaggccgacuacuacugcggcaccugggacaccagccugagcgccggcggcguguucggcaccggcaccaaggugaccgugcug

SEQ ID NO: 33153 - RNA, 333 nt, Artificial Sequence
  derived and/or modified sequence opt4 from anti-HIV_048-227770_VR-Chain
cagagcgugcugacccagccccccagcgugagcggcgcccccggccagagagugaccaucagcugcaccggcagcagcagcaacaucggccccagagacgugcacugguaccagcagcugcccggcaccgugcccaagcugcugaucuacgacaccuacaccagacccagcggcauccccgacagauucagcggcagcaagagcggcgccagcgccacccuggacaucaccggccugcagaccggcgacgaggccgacuacuacugcggcaucugggacaccagccugagcgccggcggcguguucggcaccggcaccaaggugaccgugcug

SEQ ID NO: 33154 - RNA, 333 nt, Artificial Sequence
  derived and/or modified sequence opt4 from anti-HIV_048-225298_VR-Chain
cagagcgcccugacccagcccagaagcgugagcggcagccccggccagagcgugaccaucagcugcaccggcaccagcaacgacgugggcuacgacuacgugagcugguaccagcagcugcccggcaccgcccccaagcugcugaucuacgacaucaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33155 - RNA, 327 nt, Artificial Sequence
  derived and/or modified sequence opt4 from anti-HIV_048-225090_VR-Chain
gagcugacccagccccccagcgugagcggcgcccccggccagagagugaccaucagcugcaccggcagcagcagcaacaucggcggcuacgacgugcacugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33156 - RNA, 333 nt, Artificial Sequence
  derived and/or modified sequence opt4 from anti-HIV_048-224187_VR-Chain
cagagcgugcugacccagccccccagcgccagcggcacccccggccagagagugaccaucagcugcagcggcagcagcgccaacaucggcaccaacuacguguucugguaccagcaccugcccggcaccacccccagacugcugaucuucagaaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33157 - RNA, 333 nt, Artificial Sequence
  derived and/or modified sequence opt4 from anti-HIV_048-223055_VR-Chain
cagagcgugcugacccagccccccagcgugagcgccgcccccggccagaaggugaccaucagcugcagcggcagcagcagcaacaucggcaacaacuacgugagcugguaccagcaguuccccggcaccgcccccaaggugcugaucuacggcaacagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33158 - RNA, 333 nt, Artificial Sequence
  derived and/or modified sequence opt4 from anti-HIV_048-222711_VR-Chain
cagcccgugcugacccagccccccagcgugagcggcgcccccggccagagagugaccaucagcugcaccggcagcagcagcaacaucggcggcuacgacgugcacugguaccagcaggugcccggcaccgcccccaagcugcugaucuucgagaacaacagaagacccagcggcauccccgacagauucagcggcagcaagagcggcaccagcgccacccuggccaucaccggccugcagaccggcgacgaggccgacuacuacugcggcaccugggacggcagccugagcaccggcggcgugaucggcaccggcaccaaggugaccgugcug

SEQ ID NO: 33159 - RNA, 333 nt, Artificial Sequence
  derived and/or modified sequence opt4 from anti-HIV_048-221209_VR-Chain
cagagcgugcugacccagccccccagcgugagcggcgcccccggccagagagugaccaucagcugcaccggcaacagcagcaacaucggcgacuacgacgugcacugguaccagcagguggccggcaccgcccccaagcugcugaucuucaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33160 - RNA, 333 nt, Artificial Sequence
  derived and/or modified sequence opt4 from anti-HIV_048-220629_VR-Chain
cagagcgcccugacccagcccgccagcgugagcggcagccugggccagagcaucaccaucagcugcaccggcaccagcagagacgugggcuacagcuacgugagcugguaccagcaccugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33161 - RNA, 333 nt, Artificial Sequence
  derived and/or modified sequence opt4 from anti-HIV_048-219430_VR-Chain
cagagcgugcugacccagccccccagcgugagcgccgcccccggccagauggugaccaucagcugcagcggcagcaccagcaacaucggcaucaacuacgugagcugguaccagcacgugcccggcaccgcccccaagcugcugaucuacgacaacaacaagagacccagcggcauccccgacagauucagcggcagcaagagcggcaccagcgccacccugggcaucaccggccugcacaccggcgacgaggccgacuacuacugcggcaccugggacaccagccugagcgccggcggcguguucggcaccggcaccaaggugaccgugcug

SEQ ID NO: 33162 - RNA, 333 nt, Artificial Sequence
  derived and/or modified sequence opt4 from anti-HIV_048-216250_VR-Chain
cagagcgugcugacccagccccccagcgugagcgccgcccccggccagaaggugaccaucagcugcaccggcaccaccagcgacuucggcuacaacugcgugagcugguaccagcagcaccccggcagagcccccaaggugaucaucagcggcgugaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33163 - RNA, 321 nt, Artificial Sequence
  derived and/or modified sequence opt4 from anti-HIV_048-216133_VR-Chain
acccagccccccagccugagcgccacccccggccagagagugagcaucagcugcagcggcggcggcagcaacaucggcaacaacgacguguucugguuccagcaguuccccggcgccggccccagacugcugaucuacgacaaccacaagagacacuacggcacccccgacagauucagcggcagcaagagcggcaccagcgccacccuggccaucaccggccugcagaccggcgacgaggccgccuacuacugcggcaccugggacggcagccugagcaccggcggcgugaucggcaccggcaccaaggugaccgugcug

SEQ ID NO: 33164 - RNA, 333 nt, Artificial Sequence
  derived and/or modified sequence opt4 from anti-HIV_048-214886_VR-Chain
cagagcgcccugacccagcccagaagcgugagcggcagccccggccagagcgugaccaucagcugcaccggcaccagcagcgacgugggcuacaacuacgugagcugguaccagcaccaccccggcaccgcccccaagcugcugaucuacaagaacaacaacagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33165 - RNA, 333 nt, Artificial Sequence
  derived and/or modified sequence opt4 from anti-HIV_048-214709_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaacgacagaagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33166 - RNA, 333 nt, Artificial Sequence
  derived and/or modified sequence opt4 from anti-HIV_048-214001_VR-Chain
cagagcgugcugacccagccccccagcgugagcggcgcccccggccagaccgugaccaucagcugcagcggcagcaacagcaacaucggcaaccacgacgugcacugguaccagcacgugcccggcaccgcccccaagcugcugaucuacgacaacaacaagagacccagcggcauccccgacagauucagcggcagcaagagcggcaccagcgccacccugggcaucaccggccugcagaccggcgacgaggccgaguacuacugcgccaccugggacgccagccugagcggcggcggcguguucagaaccggcaccaaggugaccgugcug

SEQ ID NO: 33167 - RNA, 333 nt, Artificial Sequence
  derived and/or modified sequence opt4 from anti-HIV_048-213230_VR-Chain
cagagcgugcugacccagccccccagcaugagcgccgcccccggccagaaggugaccaucagcugcagcggcagcagcaacaacaucggcaagaacguggugagcugguaccagcagcugcccggcaccgcccccaaggugcugaucuacgagaacaacaagagacugagcggcauccccgacagauucagcggcagcaagagcggcaccagcgccacccuggugaucaccggccugcagaccggcgacgaggccgacuacuacugcggcaccugggacagcagccugagcgccggcggcguguucggcaccggcaccaaggugaccgugcug

SEQ ID NO: 33168 - RNA, 333 nt, Artificial Sequence
  derived and/or modified sequence opt4 from anti-HIV_048-212574_VR-Chain
cagagcgugcugacccagccccccagcgugagcgccgcccccggccagagagugaccgugagcugcagcggcagcaccagcaacaucgagagcaacuacgugagcugguaccagcaggugcccggcaccgcccccaagcugcugaucuacgagaacaacaagagacccagcggcauccccgacagauucagcggcagcaagagcggcaccagcgccacccuggccaucaccggccugcagaccggcgacgaggccgccuacuacugcggcaccugggacggcagccugagcaccggcggcgugaucggcaccggcaccaaggugaccgugcug

SEQ ID NO: 33169 - RNA, 333 nt, Artificial Sequence
  derived and/or modified sequence opt4 from anti-HIV_048-212207_VR-Chain
cagagcgugcugacccagccccccagccugagcgccgcccccggccagaaggugaccaucagcugcagcggcggcagcagcaacaucggcaacaacuacgugagcugguaccagcaccugcccggcaccgcccccaagcugcugaucuacgacaacuacaagagacccagcggcauccccgacagauucagcggcagcaagagcggcaccagcgccacccuggacaucaccggccugcagaccggcgacgaggccgacuacuacugcggcaccugggacaccagccugagcgccggcggcguguucggcaccggcaccaaggugaccgugcug

SEQ ID NO: 33170 - RNA, 333 nt, Artificial Sequence
  derived and/or modified sequence opt4 from anti-HIV_048-209146_VR-Chain
cagagcgugcugacccagccccccagcgugagcggcgcccccggccagaagaucaccgugagcugcaccggcaccaccagcaacaucggcccccacgacgugcacugguaccagcuggugcccggcagaccccccaagcugcugaucuuccacaacaacaucagacccagcggcauccccgacagauucagcggcagcaagagcggcaugagcgccacccugggcaucaccggccugcagaccggcgacgaggccgacuacuacugcggcaccugggacagcagccugagcgccggcggcguguucggcaccggcaccaaggugaccgugcug

SEQ ID NO: 33171 - RNA, 333 nt, Artificial Sequence
  derived and/or modified sequence opt4 from anti-HIV_048-208206_VR-Chain
cagagcgugcugacccagccccccagcgugagcgccgcccccggccagaaggugaccaucagcugcagcggcagcagcagcaacaucggcagcaacuacgugagcugguaccagcaguuccccggcaccgcccccagacugcugaucuacgagaacgacaagagacccagcgccauccccgacagauucagcggcagcaagagcggcaccagcgccacccugggcaucaccggccugcacaccggcgacgaggccgacuacuacugcggcaccugggacggcagccugagcaccggcggcgugaucggcaccggcaccaaggugaccgugcug

SEQ ID NO: 33172 - RNA, 333 nt, Artificial Sequence
  derived and/or modified sequence opt4 from anti-HIV_048-208194_VR-Chain
cagagcgcccugacccagccccccagcgccagcggcagccccggccagagcgugaccaucagcugcaccggcaccagcagcgacaucggcuacaaguacgugagcugguaccagcugcugcccggcaccccccccaagcugcugaucuucaagaacaacgagagacccagcggcauccccgacagauucagcggcagcaagagcggcaccagcgccacccugggcaucaccggccugcagaccggcgacgaggccgacuacuacugcggcgccugggacaccagccugagcgccggcggcguguucggcaccggcaccaaggugaccgugcug

SEQ ID NO: 33173 - RNA, 333 nt, Artificial Sequence
  derived and/or modified sequence opt4 from anti-HIV_048-207744_VR-Chain
cagagcgcccugacccagcccgccagcgugagcgccagcuucggccagagcaucaccaucagcugcaccggcgccgccagcaccaucggcaacaaccuggugagcugguacagacugcugcccggcaccgcccccaagcugcugaucuacaagaacgacaacagacccagcggcauccccgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 33174 - RNA, 333 nt, Artificial Sequence
  derived and/or modified sequence opt4 from anti-HIV_048-206501_VR-Chain
cagagcgugcugacccagccccccagcgugagcggcgcccccggccagagagugaccaucagcugcagcggcagcagcagcaacaucggcaacaacgccgugaacugguaccagcagcugcccggcaaggcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33175 - RNA, 333 nt, Artificial Sequence
  derived and/or modified sequence opt4 from anti-HIV_048-204221_VR-Chain
cagagcgugcugacccagccccccagcgccagcggcacccccggccagagagugaccaucagcugcuucggcagcagcagcaacaucgccagcagcgccgugaacugguaccagcagcugcccggcaccgcccccaagcugcugaucuacaagaacgacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33176 - RNA, 333 nt, Artificial Sequence
  derived and/or modified sequence opt4 from anti-HIV_048-204015_VR-Chain
cagagcgugcugacccagccccccagcgccagcggcacccccggccagagagugaccaucagcugcagcggcagcagcagcaacaucggcagcaaguacguguacugguaccagcagcugcccggcaccgcccccaagcugcugaucuacaagaacgacaacagacccagcggcauccccgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 33177 - RNA, 333 nt, Artificial Sequence
  derived and/or modified sequence opt4 from anti-HIV_048-201240_VR-Chain
cagagcgugcugacccagccccccagcgugagcgccgcccccggccagaaggugaccaucagcugcagcggcagcagcagcaacaucggcaacaacuacguggccugguaccagcagcugcccggcaccgcccccaagcugcugaucaaggagaacagccagagacccagcggcauccccgacagauucagcggcagcaagagcggcaccagcgccacccuggccaucaccggccugcagaccggcgacgaggccgacuacuacugcggcaccugggacaccagccugagcaccggcggcguguucggcaccggcaccaaggugaccgugcug

SEQ ID NO: 33178 - RNA, 333 nt, Artificial Sequence
  derived and/or modified sequence opt4 from anti-HIV_048-200455_VR-Chain
cagagcgcccugacccagcccgccagcgugagcggcagccccggccagagcaucaccaucagcugcaccggcaccagcagcgacgugggcuacaacuacgugagcugguaccaggugcugcccggcaccgcccccaagcugcugaucuacaagaacaccgagagacccagcggcauccccgacagauucagcggcagcaagagcggcaccagcgccacccuggacaucaccggccugcagaccggcgacgaggccgacuacuacugcggcaccugggacaccagccugagcgccggcggcguguucggcaccggcaccaaggugaccgugcug

SEQ ID NO: 33179 - RNA, 333 nt, Artificial Sequence
  derived and/or modified sequence opt4 from anti-HIV_048-200319_VR-Chain
cagagcguggugacccagccccccagcgccagcggcacccccggccagagagugaccaucagcugcagcggcagcagcagcaacaucggcagcaaguacguguacugguaccaccagcaccccggcaccgcccccaagcugcugaucuacgacaacaacaacagacccagcggcauccccgacagauucagcggcagcaagagcggcaccagcgccacccugggcaucaccggccugcagaccggcgacgaggccgacuacuacugcggcaccugggacaccagccugagcagaggcggcguguucggcaccggcaccaaggugaccgugcug

SEQ ID NO: 33180 - RNA, 333 nt, Artificial Sequence
  derived and/or modified sequence opt4 from anti-HIV_048-197896_VR-Chain
cagagcgugcugacccagccccccagcgugagcgccgcccccggccagaaggugaccaucagcugcagcggcgccagcuacaacaucggcaagaacagcgugagcugguaccagcagcugcccggcaccccccccaagcugcugaucuucaagaacaacgagagacccagcggcauccccgacagauucagcggcagcaagagcggcaccagcgccacccugggcaucaccggccugcagaccggcgacgaggccgacuacuacugcgccaccugggacaccagccugagcgccggcggcguguucggcaccggcaccaaggugaccgugcug

SEQ ID NO: 33181 - RNA, 333 nt, Artificial Sequence
  derived and/or modified sequence opt4 from anti-HIV_048-193813_VR-Chain
cagagcgugcugacccagagccccagcgugagcgccgcccccggccagaaggugaccaucagcugcagcggcagcaacagcaacgugggcaacuacuacgugagcugguaccagcaccugcccggcaccgcccccaaggugcugaucuacgagggcaacaagagacccagcggcgugcccgacagauucagcggcagcaagagcggcaccagcgccagccuggccaucaccggccugcagaccggcgacgaggccgacuacuacugcggcaccugggacaccagccugagcgccggcggcguguucggcagcggcaccaaggugaccgugcug

SEQ ID NO: 33182 - RNA, 333 nt, Artificial Sequence
  derived and/or modified sequence opt4 from anti-HIV_048-192098_VR-Chain
cagagcgugcugacccagccccccagcgccagcggcacccccggccagagagugaccaucagcugcagcggcagcaccagcaacaucggcagcaacuacguguacugguaccagcagcugcccggcaccacccccaagcugcugaucuacgagaacaacaagagacccagcggcaucaccgacagauucuucggcagcaagagcggccccagcgccacccuggacaucaccggccugcagaccggcgacgaggccgacuacuacugcggcaccugggacgccagccugagcgccggcggcguguucggcaccggcaccaaggugaccgugcug

SEQ ID NO: 33183 - RNA, 333 nt, Artificial Sequence
  derived and/or modified sequence opt4 from anti-HIV_048-191786_VR-Chain
cagagcgugcugacccagccccccagcgugagcgccgcccccggccagaacgugaacaucagcugcagcggcagcagcagcaacaucgagaacaacuucgugagcugguaccagaagcugcccggcaccgcccccaagcugcugaucuacgacaacaacaagagacccagcggcaucagagacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33184 - RNA, 333 nt, Artificial Sequence
  derived and/or modified sequence opt4 from anti-HIV_048-188746_VR-Chain
cagagcgugcugacccagccccccagcgccagcggcacccccggccagaaggugaccaucagcugcagcggcagcaacagcaacaucggcagcaacuucgugagcugguaccagcugcugcccggcaccacccccaagcugcugaucuacagaaacaaccagagacccagcggcgugcccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33185 - RNA, 333 nt, Artificial Sequence
  derived and/or modified sequence opt4 from anti-HIV_048-185937_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaacaacaagagacccagcggcauccccuaccccaucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33186 - RNA, 333 nt, Artificial Sequence
  derived and/or modified sequence opt4 from anti-HIV_048-184849_VR-Chain
cagagcgugcugacccaggcccccagcgccagcggcacccccggccagaccgugaccaucagcugcagcggcagcagcagcaacaucggcaccaaguacguguacugguaccagcagcugcccggcaccgcccccaagcugcugaucuacaagaacaacgagagacccagcggcauccccgacagauucagcggcagcaagagcggcaccagcgccacccugggcaucaccggccugcagaccggcgacgaggccgacuacuacugcggcaccugggacaccagccugagccccggcggcguguucggcaccggcaccaaggugaccgugcug

SEQ ID NO: 33187 - RNA, 333 nt, Artificial Sequence
  derived and/or modified sequence opt4 from anti-HIV_048-183089_VR-Chain
cagagcgugcugacccagccccccagcgccagcggcacccccggccagagagugaccaucagcugcagcggcagcagcagcaacaucggcagcagcuacguguacugguaccagcugcugcccggcaccccccccaagcugcugaucuucaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33188 - RNA, 333 nt, Artificial Sequence
  derived and/or modified sequence opt4 from anti-HIV_048-181509_VR-Chain
cagagcgugcugacccagccccccagcgugagcggcgcccccggccagagagugaccaucagcugcaccggcagcagcagcaacaucggcggcuacgacgugcacugguaccaccagcugcccggcgccgcccccaagcugcugaucuacaagaacgacaacagacccagcggcauccccgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 33189 - RNA, 333 nt, Artificial Sequence
  derived and/or modified sequence opt4 from anti-HIV_048-180990_VR-Chain
cagagcgugcugacccagccccccagcgugagcgccgcccccggccagagagugaccaucagcugcagcggcagcaccagcaacaucggcaacaacuacgugagcugguaccagcacuuccccggcaaggugcccaagguggugaucagcgagaccaccaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33190 - RNA, 333 nt, Artificial Sequence
  derived and/or modified sequence opt4 from anti-HIV_048-177532_VR-Chain
cagagcgcccugacccagccccccagcgccagcggcagccugggccagagcgugaccaucagcugcaccggcaccagcagcgacgugggcaacaacuucgugagcugguaccagaagaagcccggcaaggcccccaagcugaucguguacgaggugaacaagagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33191 - RNA, 324 nt, Artificial Sequence
  derived and/or modified sequence opt4 from anti-HIV_048-177426_VR-Chain
cugacccagccccacagcgugagcgagagccccggcaagaccgugaccaucagcugcaccggcaccagcagcgacgugggcuacaacuacgugagcugguaccagcaccaccccggcaaggcccccaagcugcugaucuacgaggugaccaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33192 - RNA, 333 nt, Artificial Sequence
  derived and/or modified sequence opt4 from anti-HIV_048-177389_VR-Chain
cagagcgugcugacccagccccccagcaugagcgccgcccccggcgagagagugaccaucagcugcagcggcagcagcagcaacaucggcaaccaccacgugagcugguaccagcagagacccggcaccgcccccaagcugcugaucuacgagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33193 - RNA, 333 nt, Artificial Sequence
  derived and/or modified sequence opt4 from anti-HIV_048-174266_VR-Chain
cagagcgugcugacccagccccccagcgugagcggcgcccccggccagagagugaccaucagcugcagcggcagcagcagcaacaucggcagccacuacgugagcugguaccagcaggugcccggcaccgcccccagacuggugaucuacgacaccaucaagagacacagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33194 - RNA, 333 nt, Artificial Sequence
  derived and/or modified sequence opt4 from anti-HIV_048-172847_VR-Chain
cagagcgugcugacccagccccccagcgugagcgccgcccccggccagagagugaccgugagcugcagcggcagcaccagcaacaucgagagcaacuacgugagcugguaccagcaggugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33195 - RNA, 333 nt, Artificial Sequence
  derived and/or modified sequence opt4 from anti-HIV_048-172845_VR-Chain
cagagcgcccugacccagccccccagcgccagcggcagccccggccagagcgugaccaucagcugcaccggcaccagcagcgacgugggcuacaacuacgugagcugguaccagcagcugcccggcaccgcccccaagcugcugaucuacagaaacaaccagagacccagcggcgugcccgacagauucagcggcagcaagagcggcaccagcgccacccugggcaucaccggccugcagaccggcgacgaggccgacuacuacugcgccaccugggacaccagccugagcgccggcggcguguucggcaccggcaccaaggugaccgugcug

SEQ ID NO: 33196 - RNA, 333 nt, Artificial Sequence
  derived and/or modified sequence opt4 from anti-HIV_048-172363_VR-Chain
cagagcgugcugacccagccccccagcgugagcgccgcccccggccagaaggugaccaucagcugcagcggcagcggcagcaacaucggcaacaccuacgugagcugguaccagcagcugcccggcaccgcccccaagcugcugaucuucgaggacaacaagagacccagcggcauccccgacagauucagcggcagcaagagcggcaccagcgccacccuggccaucaccggccugcagaccggcgacgaggccgacuacuacugcggcaccugggacagcagccugagcggcggcggcgugaucggcaccggcaccaagcugaccgugcug

SEQ ID NO: 33197 - RNA, 333 nt, Artificial Sequence
  derived and/or modified sequence opt4 from anti-HIV_048-171609_VR-Chain
cagagcgugcugacccagccccccagcgugagcgccgcccccggccaggaggugaccaucagcugcagcgccagcagcagcagcaucggcaacgacuucgugagcugguaccagcagcugcccggcaccgcccccaagcugcugaucuacggcaacagcaacagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33198 - RNA, 333 nt, Artificial Sequence
  derived and/or modified sequence opt4 from anti-HIV_048-170705_VR-Chain
cagagcgugcugacccagccccccagcgugagcgccgcccccggccagauggugaccaucagcugcagcggcagcaccagcaacaucggcaucaacuacgugagcugguaccagcacgugcccggcaccgcccccaagcugcugaucuacgagaacguggagagaagaagcggcauccccgacagauucagcgccagcaagagcgccaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33199 - RNA, 333 nt, Artificial Sequence
  derived and/or modified sequence opt4 from anti-HIV_048-168381_VR-Chain
cagagcgcccugacccagcccgccagcgugagcggcagccccggccagagcaucaccaucagcugcaccggcaccagcagcaacaucggcagcaacuacgugagcugguaccagcagcugcccggcaccgcccccaagcugcugaucuacgagaacaaccagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33200 - RNA, 333 nt, Artificial Sequence
  derived and/or modified sequence opt4 from anti-HIV_048-166619_VR-Chain
cagagcgugcugacccagccccccagcgugagcggcgcccccggccagagagugaccaucagcugcaccggcagcagcagcaacaucggcggcuaccacacccacugguaccagcagcugcccggcaccgcccccaagcugcugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33201 - RNA, 333 nt, Artificial Sequence
  derived and/or modified sequence opt4 from anti-HIV_048-162036_VR-Chain
cagagcgugcuggcccagccccccagcgugagcggcgcccccggccagaccgugaccaucagcugcaccggcagcagcagcaacaucggcggcuacgacgugcacugguaccagcagcugcccggcaccgcccccaagcugcugaucuacaaggacgacaagagacccagcggcauccccgacagauucagcggcagcaagagcggcaccagcgccacccugggcaucaccggccugcagaccggcgacgaggccgacuacuacugcggcaccugggacaccagccugaacagaggcggcguguucggcaccggcaccaaggugaccgugcug

SEQ ID NO: 33202 - RNA, 333 nt, Artificial Sequence
  derived and/or modified sequence opt4 from anti-HIV_048-160042_VR-Chain
cagagcgugcugacccagccccccagcgugagcgccgcccccggccagaaggugaccaucagcugcagcggcagcagcagcaacaucggcaucaacuacaucagcugguaccagcagcugcccggcaccgcccccaagauccugaucuacgacaacgacaagagaccccugggcauccccgacagauucagcggcagcaagagcggcaccagcgccacccugggcaucaccggccugcagaccggcgacgaggccgacuacuacugcggcaccugggacgccagccugagcgccggcggcguguucggcaccggcaccaaggugaccgugcug

SEQ ID NO: 33203 - RNA, 333 nt, Artificial Sequence
  derived and/or modified sequence opt4 from anti-HIV_048-159676_VR-Chain
cagagcgugcugacccagccccccagcgugagcgccagccccggccagaaggugaccaucagcugcagcggcagcagcagcgacaucggcagcaacuacgugagcugguacgugcagcugcccggcaccgcccccaagcugcugaucuacaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33204 - RNA, 333 nt, Artificial Sequence
  derived and/or modified sequence opt4 from anti-HIV_048-159500_VR-Chain
cagagcgugcugacccagccccccagcgugagcgccgcccccggccagaacgugaccaucagcugcagcggcagcuggagcaacaucggcgccaacuacgugagcugguaccagcagcugcccggcaccgcccccaagcugcugaucuacgagaacaacaagagacccagcggcauccccgacagauucagcggcagcaagagcggcaccagcgccacccugggcuucaccggccugcagaccggcgacgaggccgacuacuacugcggcaccugggacaccagccugagcgccggcggcguguucggcaccggcaccaaggugaccgugcug

SEQ ID NO: 33205 - RNA, 333 nt, Artificial Sequence
  derived and/or modified sequence opt4 from anti-HIV_048-159421_VR-Chain
cagagccugcugacccaggcccccagcgugagcgccgcccccggccagaccgugaccaucagcugcagcggcagcaacgccgacaucggcaagaacuucgugagcugguaccagcagagccccggcgccgcccccaagcugcugaucuacgagaacgacagaagacccagcggcauccccgacagauucagcggcagcaagagcggcaccagcgccacccugggcaucaccggccugcagaccggcgacgaggccgaguacuacugcgccaccugggacgccagccugagcggcggcggcguguucggcaccggcaccaaggugaccgugcug

SEQ ID NO: 33206 - RNA, 333 nt, Artificial Sequence
  derived and/or modified sequence opt4 from anti-HIV_048-159333_VR-Chain
cagagcgugcugacccagccccccagcgccagcggcacccccggccagagagugaccaucagcugcagcggcagcaacagcaacaucggcagcgacagcguguacugguaccagcagcugcccggcagaagccccaagcugcugaucuacagaaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33207 - RNA, 333 nt, Artificial Sequence
  derived and/or modified sequence opt4 from anti-HIV_048-158932_VR-Chain
cagagcgugcugacccagcccgccagcgugagcggcagccccggccagagcaucaccaucagcugcagcggcagcagcagcaacaucggcgacaucuucgugagcugguaccagcaggugcccggcgccgcccccaagcugcugaucuacgacaacgacaagagacccagcggcauccccgacagauucagcggcagcaagagcggcaccagcgccacccuggacaucaccggccugcagaccggcgacgaggccgacuacuacugcggcaccugggacaccagccugagcgccggcggcguguucggcaccggcaccaaggugaccgugcug

SEQ ID NO: 33208 - RNA, 333 nt, Artificial Sequence
  derived and/or modified sequence opt4 from anti-HIV_048-155811_VR-Chain
cagagcgcccugacccagcccgccagcgugagcggcagccccggccagagcaucaccaucagcugcaccggcaccagcagcgacgugggcuacgacuacgugagcugguaccagcugcugcccggcaccccccccaagcugcugaucuucaagaacaacgagagacccagcggcauccccgacagauucagcggcagcaagagcggcaccagcgccacccugggcaucaccggccugcagaccggcgacgaggccgacuacuacugcgccaccugggacaccagccugagcgccggcggcguguucggcaccggcaccaaggugaccgugcug

SEQ ID NO: 33209 - RNA, 333 nt, Artificial Sequence
  derived and/or modified sequence opt4 from anti-HIV_048-155464_VR-Chain
cagagcgcccugacccagcccgccagcgugagcggcagccccggccagagcaucaccaucagcugcaccggcgccaccggcgacagcggccacaccuacgugagcugguaccagcagcugcccggcaccgcccccaagcugcugaucuacagcaacaacgagagacccagcggcgugcccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33210 - RNA, 333 nt, Artificial Sequence
  derived and/or modified sequence opt4 from anti-HIV_048-155392_VR-Chain
cagagcgugcugacccagccccccagcgugagcgccgcccccggccagauggugaccaucagcugcagcggcagcagcagcaacaucggcgacaacuacgugagcugguaccagcagcugcccggcagaggccccaagcugcugguguacgacaccuacaagagauaccuggagacccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33211 - RNA, 333 nt, Artificial Sequence
  derived and/or modified sequence opt4 from anti-HIV_048-155389_VR-Chain
cagagcgugcugacccagccccccagcgugagcgccgcccccggccagaaggugaccaucagcugcagcggcaucagcagcaacaucggcaacaaccccgugagcugguaccagcaguuccccggcaccgcccccaagcugcugaucuacaagaacgacaagagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33212 - RNA, 333 nt, Artificial Sequence
  derived and/or modified sequence opt4 from anti-HIV_048-154449_VR-Chain
cagagcgugcugaagcagccccccagcgugagcggcgcccccggccugagagugaccaucagcugcaccggcggcagcagcaacaucggcggcuucgacgugcacugguaccagcacuuccccggcaccgcccccaagcugcugaucuacgacaacgaccagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33213 - RNA, 333 nt, Artificial Sequence
  derived and/or modified sequence opt4 from anti-HIV_048-153379_VR-Chain
cagagcgugcugacccagccccccagcgugagcgccacccccggccagaaggugaccaucagcugcagcggcagcagaagcaacaucggcagccacuacgugagcugguaccagcaguuccccgagagcgcccccaagcugcugaucuacaagaacgacaacagacccagcggcauccccgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 33214 - RNA, 333 nt, Artificial Sequence
  derived and/or modified sequence opt4 from anti-HIV_048-153171_VR-Chain
cagagcgugcugacccagccccccagcgugagcgccgcccccggccagaaggugaccaucagcugcagcggcagcaccagcaacaucgaggacaucuacgugagcugguaccagcaccugcccggcaccgcccccaagcugcugaucuacgacaacaacaagagacccagcggcauccccgacagauucagcggcagcaagagcggcaccagcgccacccuggccaucaccggccugcagaccggcgacgaggccgacuacuacugcggcaccugggacaccagccugagcgccggcggcguguucggcaccggcaccaaggugaccgugcug

SEQ ID NO: 33215 - RNA, 333 nt, Artificial Sequence
  derived and/or modified sequence opt4 from anti-HIV_048-152324_VR-Chain
cagagcauggugacccagagccccagcgugagcgccgcccccggccagaaggugaccaucagcugcagcggcaccagcagcaacaucggccagaacuacgugagcugguaccagcagcugcccggcaccgcccccaagcugcugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33216 - RNA, 333 nt, Artificial Sequence
  derived and/or modified sequence opt4 from anti-HIV_048-146102_VR-Chain
cagagcgugcugacccagccccccagcgugagcgccgcccccggccagaaggugaccaucagcugcagcggcagcagcagcaccaucggcaacaacuacaucagcugguaccagcugcugcccggcaccccccccaagcugcugaucuacaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33217 - RNA, 333 nt, Artificial Sequence
  derived and/or modified sequence opt4 from anti-HIV_048-145984_VR-Chain
cagagcgugcugacccagccccugagcgugagcggcgcccccggccagagagugaccaucagcugcaccggcagcagcagcaacaucggcagcaacuucgugagcugguaccaggugcugcccggcaccacccccaagcugcugaucuucaagaacaacgagagacccagcggcauccccgacagauucagcggcagcaagagcggcaccagcgccacccugggcaucaccggccugcagaccggcgacgaggccgacuacuacugcggcgccugggacaccagccugagcgccggcggcguguucggcaccggcaccaaggugaccgugcug

SEQ ID NO: 33218 - RNA, 333 nt, Artificial Sequence
  derived and/or modified sequence opt4 from anti-HIV_048-145371_VR-Chain
cagagcgugcugacccagccccccagcgugagcgccgccagcggccagaaggugagcauccccugcagcggcggcaccagcaacaucggcgacaacuacgugagcugguuccagcaguuccccggcagcgcccccaagauccugaucuacgacagcgacaagagacccagcagaaucagcgacagauucagcgccagcaagagcggcaccagcgccacccuggacaucaccagacugcagaccggcgacgaggccgacuacuacugcggcaccugggacaccagccugagcgccggcggcguguucggcaccggcaccaaggugaccgugcug

SEQ ID NO: 33219 - RNA, 333 nt, Artificial Sequence
  derived and/or modified sequence opt4 from anti-HIV_048-144907_VR-Chain
cagagcgcccugacccagcccgccagcgugagcggcagccccggccagagcaucaccaucagcugcaccggcaccagaagagacgugggcuucaacuacgugagcugguaccagcagcaccccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33220 - RNA, 333 nt, Artificial Sequence
  derived and/or modified sequence opt4 from anti-HIV_048-142298_VR-Chain
cagagcgugcugacccagccccccagcgccagcggcacccccggccagagagugaccaucagcugcagcggcagcagcagcaccaucggcaacaacuacaucagcugguaccagcugcugcccggcaccccccccaagcugcugaucuucaagaacaacgagagacccagcggcauccccgacagauucagcgccagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33221 - RNA, 333 nt, Artificial Sequence
  derived and/or modified sequence opt4 from anti-HIV_048-142277_VR-Chain
cagagcgugcugacccagccccccagcgugagcggcgcccccggccagagaaucaccaucagcugcaccggcagcagcagcaacaucggcgccuacgacgugcagugguaccagcaccugcccggcaccgcccccaagcugcugaucuacaagaacaccgagagacccagcggcauccccgacagauucagcggcagcaagagcggcaccagcgccacccuggacaucaccggccugcagaccggcgacgaggccgacuacuacugcggcaccugggacaccagccugagcgccggcggcguguucggcaccggcaccaaggugaccgugcug

SEQ ID NO: 33222 - RNA, 333 nt, Artificial Sequence
  derived and/or modified sequence opt4 from anti-HIV_048-141934_VR-Chain
cagagcgugcugacccagccccccagcgugagcggcgcccccggccagagagugaccaucagcugcaccggcaacagcagcaacaucggcgccuacgacgugcacugguaccagcagcugcccggcaccgcccccaagcugaugaucuacgaggugagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33223 - RNA, 333 nt, Artificial Sequence
  derived and/or modified sequence opt4 from anti-HIV_048-141207_VR-Chain
cagagcgugcugacccagccccccagcgugagcgccgcccccggccagaaggugaccaucgccugcagcggcagcagcagcaacaucggcaacaacuacgugagcugguaccagcagcugcccggcaccgcccccaagcugcugaucuacgccaacaacagaagacccagcggcauccccgacagauucagcgccagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33224 - RNA, 333 nt, Artificial Sequence
  derived and/or modified sequence opt4 from anti-HIV_048-140796_VR-Chain
cagagcgugcugacccagccccccagcgugagcgccacccccggccagaaggugaccaucagcugcagcggcaccagaagcaacaucggcaacaacuacgugagcugguacagacaguuccccggcaccgcccccaagcugcugaucuacgaggacaacaagagacccagcggcauccccgccagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33225 - RNA, 333 nt, Artificial Sequence
  derived and/or modified sequence opt4 from anti-HIV_048-139893_VR-Chain
cagagcgugcugacccagccccccagcgugagcgccacccccggccagaaggugaccuucagcugcagcggcagcagcagcaccaucggcaagaacuacgugagcugguaccaggugcugcccggcaccgcccccaagcugcugaucuacaagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33226 - RNA, 333 nt, Artificial Sequence
  derived and/or modified sequence opt4 from anti-HIV_048-138820_VR-Chain
cagagcgugcugacccagccccccagcgugagcggcgcccccggccagaaggugaccaucagcugcagcggcagcggcagcaacaucggcaacaccuacgugagcugguaccagcaccugcccggcaccgcccccaagcugcugaucuacgagaacaacaagagacccagcggcauccccgacagauucagcggcagcaagagcgccaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33227 - RNA, 333 nt, Artificial Sequence
  derived and/or modified sequence opt4 from anti-HIV_048-135858_VR-Chain
cagagcgugcugacccagccccccagcgccagcggcacccccggccagagagugaccaucagcugcagcggcagcagcagcaacaucggcagcagcuacguguacugguaccagcaguuccccggcagaagccccagacugcugaucuacagaaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33228 - RNA, 333 nt, Artificial Sequence
  derived and/or modified sequence opt4 from anti-HIV_048-134968_VR-Chain
cagagcgugcugacccagccccccagcgugagcgccgcccccggccagaaggugaccaucuucugcagcggcagcagcagcaacaucggcaagaacuacgugagcugguaccagcagcugcccggcaccgcccccaagcugcugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33229 - RNA, 333 nt, Artificial Sequence
  derived and/or modified sequence opt4 from anti-HIV_048-134312_VR-Chain
cagagcgugcugacccagccccccagcgccagcggcacccccggccagagagugaccaucagcugcagcggcagcagcagcaacaucggcaacaacuacgugagcugguacagacugcugcccggcaccgcccccaagcugcugaucuacaagaacgacaacagacccagcggcauccccgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 33230 - RNA, 330 nt, Artificial Sequence
  derived and/or modified sequence opt4 from anti-HIV_048-132253_VR-Chain
agcgcccugacccagcccgccagcgugagcggcagccccggccagagcaucgccaucagcugcaccggcaccagcagcgacgugggcuacgaccuggugagcugguaccagcagcaccccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33231 - RNA, 333 nt, Artificial Sequence
  derived and/or modified sequence opt4 from anti-HIV_048-130710_VR-Chain
cagagcgugcugacccagccccccagcguggccggcgcccccggccagagagugaccaucagcugcaccggcaacaccagcaacaucggcggcuacgacgugcacugguaccagcagcugcccggcaccccccccaagcugcugaucuucaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33232 - RNA, 333 nt, Artificial Sequence
  derived and/or modified sequence opt4 from anti-HIV_048-128564_VR-Chain
cagagcgugcugacccagccccccagcgccagcggcacccccggccagagagugaccaucagcugcagcggcagcagcagcaacaucggcagcaacaccgugaacugguaccagcagcugcccggcaccgcccccaagcugcugaucuacaagaacaccgagagacccagcggcauccccgacagauucagcggcagcaagagcggcaccagcgccacccuggacaucaccggccugcagaccggcgacgaggccgacuacuacugcggcaccugggacaccagccugagcgccggcggcguguucggcaccggcaccaaggugaccgugcug

SEQ ID NO: 33233 - RNA, 333 nt, Artificial Sequence
  derived and/or modified sequence opt4 from anti-HIV_048-126702_VR-Chain
cagagcgugcugacccagccccccagcgccagcgccgcccccggccagagagugaccaucagcugcagcggcagcaacagcaacaucggcaacaacuacgugagcugguaccagcagcugcccggcaccgcccccaagcugcugaucuacgacaacagcaagagacccagcggcauccccgacagauucagcgccagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33234 - RNA, 333 nt, Artificial Sequence
  derived and/or modified sequence opt4 from anti-HIV_048-124521_VR-Chain
cagagcgugcugacccagccccccagcgugagcggcgcccccggccagagagugaccaucagcugcaccggcagcagcagcaccuucggcggcuacgacguguacugguaccagcagauccccggcaccgcccccaagcugcugaucuacgagaacaacaagagacccagcggcauccccgacagauucagcggcagcaagagcggcaccagcgccacccuggccaucaccggccugcagaccggcgacgaggccgacuacuacugcggcaccugggacggcagccugagcaccggcggcgugaucggcaccggcaccaaggugaccgugcug

SEQ ID NO: 33235 - RNA, 333 nt, Artificial Sequence
  derived and/or modified sequence opt4 from anti-HIV_048-122740_VR-Chain
cagagcgugcugacccagccccccagcaugagcgccgcccccggccagagcgugaccaucagcugcagcggcagcaccuucaacaucgagaagcaccaggugaccuggcugagacaccugcccggcaccgcccccaccagcgugaucaucaugaacagccagagacccagcggcacccccgacagauucagcggcagcaagagcggcaccagcgccacccuggccaucaccggccugcagaccggcgacgaggccgacuacuacugcggcaccugggacggcagccugagcaccggcggcgugaucggcaccggcaccaaggugaccgugcug

SEQ ID NO: 33236 - RNA, 327 nt, Artificial Sequence
  derived and/or modified sequence opt4 from anti-HIV_048-119536_VR-Chain
gagcugacccagagccccagcgugagcgccgcccccggcgagaaggugaccaucagcugcagcggcaccaacagcaacaucggcuacuacuacgugagcugguaccagcaguuccccggcaccgcccccaagguggugaucuacgagaacaccaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33237 - RNA, 333 nt, Artificial Sequence
  derived and/or modified sequence opt4 from anti-HIV_048-116929_VR-Chain
cagagcgugcugacccagccccccagcgugagcggcgcccccggccagagagugaccaucagcugcaccggcagcagcagcaacaucggcgacuacgacgugcacugguaccagcagcugcccggcaccgcccccaagcugcugaucuacagaaacaaccagagacccagcggcgugcccgacagauucagcggcagcaagagcggcaccagcgccacccugggcaucaccggccugcagaccggcgacgaggccgacuacuacugcggcaccugggacgccagccugagcgccggcggcguguucggcaccggcaccaaggugaccgugcug

SEQ ID NO: 33238 - RNA, 333 nt, Artificial Sequence
  derived and/or modified sequence opt4 from anti-HIV_048-116577_VR-Chain
cagagcgugcugacccagccccccagcgccagcggcacccccggccagagagugaccaucagcugcagcggcagcagcagcaacaucggcagcaacuacgugagcugguaccaggugcugcccggcaccgcccccaagcugcugaucuacaagaacaacaagagacccagcggcauccccgacagauucagcggcagcaagagcggcaccagcgccacccugggcaucaccggccugcagaccggcgacgaggccgacuacuacugcgccaccugggacaccagccugagcgccggcggcguguucggcaccggcaccaaggugaccgugcug

SEQ ID NO: 33239 - RNA, 333 nt, Artificial Sequence
  derived and/or modified sequence opt4 from anti-HIV_048-116046_VR-Chain
cagagcgugcugacccagccccccagcgugagcggcgcccccggccagagagugaccaucagcugcaccggcagcagcagcaacaucggcggcuacgacgugcacugguaccagcaguuccccggcaccgcccccaagcugcugaucuacgacaacgacaagagacccagcggcauccccgacagauucagcggcagcaagagcggcaccagcgccacccugggcaucaccggccugcagaccggcgacgaggccaacuacuacugcggcgccugggacaccagccugagcgccggcggcguguucggcaccggcaccaaggugaccgugcug

SEQ ID NO: 33240 - RNA, 333 nt, Artificial Sequence
  derived and/or modified sequence opt4 from anti-HIV_048-115875_VR-Chain
cagagcgugcugacccagccccccagcgugagcgccgcccccggccagagagugaccgugagcugcagcggcagcagcagcaacaucggcaacaacuucgugagcugguaccagcaccugcccggcaccgcccccaagcugcugaucuacgacaacagcaacagacccagcggcauccccgacagauucagcggcagcaagagcggcaccagcgccacccugggcaucaccggccugcacaccggcgacgaggccgacuacuacugcggcaccugggacaccagccugagcgccggcggcguguucggcagcggcaccaaggugaccgugcug

SEQ ID NO: 33241 - RNA, 333 nt, Artificial Sequence
  derived and/or modified sequence opt4 from anti-HIV_048-115599_VR-Chain
cagagcgugcugacccagccccccagcgugagcgccgcccccggccagauggugaccaucagcugcagcggcagcagcagcaacaucggcagccacagcgugagcugguaccagcacuuccccggcaccgcccccaagcuggugaucgaggagaacgaccagagacccagcggcauccccgacagauucagcggcagcaagagcggcaccagcgccacccugggcaucaccggccugcagaccggcgacgagggcgacuacuacugcggcaccugggacaccagccugagcggcggcggcguguucggcaccggcaccaaggugaccgugcug

SEQ ID NO: 33242 - RNA, 333 nt, Artificial Sequence
  derived and/or modified sequence opt4 from anti-HIV_048-113988_VR-Chain
cagagcgugcugacccagccccccagcgugagcgccgcccccggccagauggugaccaucagcugcagcggcagcagccacaacaucggcgagaacuacgugagcugguaccagcaccugcccggcaccgcccccaagcugcugaucuucaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33243 - RNA, 333 nt, Artificial Sequence
  derived and/or modified sequence opt4 from anti-HIV_048-112989_VR-Chain
cagagcgugcugacccagccccccagcgccagcggcacccccggccagagagugacccugagcugcagcggcggcagcagcaacaucggcaacgacaacguguacugguaccagcagagacccggcaccacccccaagcugcugaucuacaacgacaacagaagacccagcggcacccccgacagauucagcggcagcaagagcggcaccagcgccacccuggccaucaccggccugcagaccggcgacgaggccgacuacuacugcggcaccugggacggcagccugagcaccggcggcgugaucggcaccggcaccaaggugaccgugcug

SEQ ID NO: 33244 - RNA, 333 nt, Artificial Sequence
  derived and/or modified sequence opt4 from anti-HIV_048-112435_VR-Chain
cagagcgugcugacccagccccccagcgugagcgccgcccccggccagaaggugagcaucagcugcagcggcagcagcagcaacaucggcaagaacuacgugagcugguaccagcagcugcccggcaccgcccccaagcugcugaucuucaagaacaacgagagacccagcggcauccccgacagauucagcggcagcaagagcggcaccagcgccacccugggcaucaccggccugcagaccggcgacgaggccgacuacuacugcgccaccugggacaccagccugagcgccggcggcguguucggcaccggcaccaaggugaccgugcug

SEQ ID NO: 33245 - RNA, 333 nt, Artificial Sequence
  derived and/or modified sequence opt4 from anti-HIV_048-111339_VR-Chain
cagagcgugcugacccagccccccagcgugagcgccgcccccggccagaaggugaccaucagcugcaccggcagcagcagcaacaucggcggcuacgccgugcacugguaccagcaggugcccgccaccgcccccaagcugcugaucuacgagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33246 - RNA, 333 nt, Artificial Sequence
  derived and/or modified sequence opt4 from anti-HIV_048-111055_VR-Chain
cagagcgcccugacccagcccgccagcgugagcggcagccccggccagagcaucaccaucagcugcaccggcaccagaagcgacgugggcuacaacuacgugagcugguaccagcagcaccccggcaaggcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33247 - RNA, 333 nt, Artificial Sequence
  derived and/or modified sequence opt4 from anti-HIV_048-111027_VR-Chain
cagagcgugcugacccagccccccagcgugagcgccgcccccggccagaaggugaccaucagcugcagcggcagcaacagcaaccugggcaacaacuacgugagcugguaccagcaccugcccggcaccgcccccagacugcugaucuacgaggacaagaagagacccagcggcauccccgacagauucagcggcagcaagagcggcgccagcgccacccuggacaucaccggccugcagaccggcgacgaggccgacuacuacugcggcaucugggacaccagccugagcgccggcggcguguucggcaccggcaccaaggugaccgugcug

SEQ ID NO: 33248 - RNA, 333 nt, Artificial Sequence
  derived and/or modified sequence opt4 from anti-HIV_048-109721_VR-Chain
cagagcgugcugacccagccccccagcgugagcgccgcccccggccagaaggugaccaucagcugcagcggcagcagcagcgacaucggcagcaacuucgugagcugguaccagcaccugcccggcaccgcccccagacugcugaucuacgagaacaacagaagacccagcggcauccccgacagauucagcggcagcaagagcggcaccagcgccacccuggccaucaccggccugcagaccggcgacgaggccgacuacuacugcggcaccugggacaccagccugaacagaggcggcguguucggcaccggcaccaaggugaccgugcug

SEQ ID NO: 33249 - RNA, 333 nt, Artificial Sequence
  derived and/or modified sequence opt4 from anti-HIV_048-109666_VR-Chain
cagagcgugcugacccagccccccagcaugagcgccgcccccggcgagagagugaccaucagcugcagcggcagcagcagcaacaucggcaaccaccacgugagcugguaccagcagagacccggcaccgcccccaagcugcugaucuacgagaacaacgagagacccagcggcauccccgacagauucagcggcagcaagagcggcagcagcgccacccuggccaucaccggccugcagaccggcgacgaggccgacuacuacugcggcaccugggacggcagacugaacaucggcggcgugaucggcaccggcaccaaggugaccgugcug

SEQ ID NO: 33250 - RNA, 333 nt, Artificial Sequence
  derived and/or modified sequence opt4 from anti-HIV_048-109196_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgagaccaacaagagacccagcggcauccccgacagauucagcggcagcaagagcggcaccagcgccacccuggccaucaccggccugcagaccggcgacgaggccgacuacuacugcggcaccugggacaccagccugagcggcggcggcguguucggcaccggcaccaaggugaccgugcug

SEQ ID NO: 33251 - RNA, 333 nt, Artificial Sequence
  derived and/or modified sequence opt4 from anti-HIV_048-109051_VR-Chain
cagagcgugcugacccagccccccagcgugagcgccgcccccggccagaaggugaccaucagcugcagcggcaacaacagcaacauggugaacaacuacaucagcugguaccagcugcugcccggcaccccccccaagcugcugaucuucaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33252 - RNA, 333 nt, Artificial Sequence
  derived and/or modified sequence opt4 from anti-HIV_048-108570_VR-Chain
cagagcgcccugacccagccccccagcgugagcgccgcccccggccagaaggugaccaucagcugcagcggcaagagcagcaacaucggcaccaacuucgugagcugguaccagcaguuccccgaggccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacggcagccugagcaccggcggcgugaucggcaccggcaccaaggugaccgugcug

SEQ ID NO: 33253 - RNA, 327 nt, Artificial Sequence
  derived and/or modified sequence opt4 from anti-HIV_048-108033_VR-Chain
gagcugacccagagccccagcgugagcgccgcccccggccagagagugaccaucagcugcagcggcaacagcagcaacaucggcaacaacuacgugagcugguaccagcugcugcccggcaccgcccccaagcugcugaucuacaagaacgacaagagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33254 - RNA, 333 nt, Artificial Sequence
  derived and/or modified sequence opt4 from anti-HIV_048-107279_VR-Chain
cagagcgugcugacccagccccccagcgugagcgccgcccccggccagaaggugaucaucagcugcagcggcagcagcagcaacaucggcaagaacuacgugagcugguaccagcaccugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacgccagccugagcgccggcggcgugcugggcaccggcaccaaggugaccgugcug

SEQ ID NO: 33255 - RNA, 333 nt, Artificial Sequence
  derived and/or modified sequence opt4 from anti-HIV_048-106271_VR-Chain
cagagcgugcugacccagccccccagcgugagcgccgcccccggccagaaggugaccaucagcugcagcggcagcagaagcaacaucggcagcaacuacaucagcugguaccagcagcugcccggcaccgcccccaagcugcugaucuacaagaacgacaagagacccagcggcauccccgacagauucagcggcagcaagagcggcaccagcgccauccugggcaucaccggccugcagaccggcgacgaggccgacuacuacugcggcgccugggacaccagccugagcgccggcggcguguucggcaccggcaccaaggugaccgugcug

SEQ ID NO: 33256 - RNA, 333 nt, Artificial Sequence
  derived and/or modified sequence opt4 from anti-HIV_048-106054_VR-Chain
cagagcgugcugacccagccccccagcgugagcgccgcccccggccagcaggugaccaucagcugcagcggcagcaccagcaacaucggcaacaacuacgugagcugguaccagcaggugcccggcaccgcccccaagcugcugaucuacgacaacaacaacagacccagcggcauccccgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 33257 - RNA, 333 nt, Artificial Sequence
  derived and/or modified sequence opt4 from anti-HIV_048-104848_VR-Chain
cagagcgcccugacccagcccgccagcgugagcggcagccccggccagagcaucaccaucagcugcaccggcaccagcagcgacgugggcuacaacuacgugagcugguaccagcagcugcccggcaccgcccccaagcugcugaucuucgacaacgacgacagacccagcgagauccccgacagauucagcggcagcaagagcggcaccagcgccacccugggcaucaccggccugcagcccggcgacgaggccgacuacuacugcggcaccugggacagcagccugagcgccggcggcguguucggcaccggcaccaaggugaccgugcug

SEQ ID NO: 33258 - RNA, 333 nt, Artificial Sequence
  derived and/or modified sequence opt4 from anti-HIV_048-104638_VR-Chain
cagagcgugcugacccagccccccagcgccagcggcacccccggccacagagugaccaucagcugcagcggcaacagcagcaacaucggcggcaaccacguguacugguaccagcaggugcccggcaccacccccaagcugcugaucuacagaaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33259 - RNA, 333 nt, Artificial Sequence
  derived and/or modified sequence opt4 from anti-HIV_048-104567_VR-Chain
cagagcgugcugacccagccccccagcgccagcggcacccccggccagagagugaccaucagcugcagcggcagcaacagcaacaucggcaccaacuucgugaacugguaccagcacgugcccggcagagcccccaagcugcugaucuacaagaacaccgagagacccagcggcauccccgacagauucagcggcagcaagagcggcaccagcgccacccuggacaucaccggccugcagaccggcgacgaggccgacuacuacugcggcaccugggacaccagccugagcgccggcggcguguucggcaccggcaccaaggugaccgugcug

SEQ ID NO: 33260 - RNA, 333 nt, Artificial Sequence
  derived and/or modified sequence opt4 from anti-HIV_048-102804_VR-Chain
cagagcgugcugacccagccccccagcgugagcaccgcccccggccagaaggugaccaucagcugcagcggcagcagcagcaacaucggcuacagcuacgugagcugguuccagcaccugcccggcaccgcccccaagcugcugaucuacggcaacagcaacagacccagcggcgugcccgacagauucagcggcagcaagagcggcaccagcgccagccuggccaucaccggccugcagaccggcgacgaggccgacuacuacugcggcaccugggacagcagccugagcgccggcggcguguucggcaccggcaccaaggugaccgugcug

SEQ ID NO: 33261 - RNA, 333 nt, Artificial Sequence
  derived and/or modified sequence opt4 from anti-HIV_048-101676_VR-Chain
cagagcgugcugacccagccccccagcgugagcggcgcccccggccagagcgugaccaucagcugcaccggcaccagcagcaacaucggcgacuucgacgugcacugguaccagcagcugcccggcaccgcccccaagcugcugcuguacgagaacaacaagagacccagcggcauccccgacagauucagcggcagcaagagcggcaccagcgccacccuggccaucaccggccugcagaccggcgacgaggccgacuacuacugcggcaccugggacggcagccugagcaccggcggcgugaucggcaccggcaccaaggugaccgugcug

SEQ ID NO: 33262 - RNA, 333 nt, Artificial Sequence
  derived and/or modified sequence opt4 from anti-HIV_048-097603_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgacaccgugaagagacccagcggcauccccgacagauucagcggcagcaagagcggcaccagcgccacccugggcaucaccggccugcagaccggcgacgaggccgacuacuacugcggcaccugggacagcagccugagcggcggcggcguguucggcaccggcaccaaggugaccgugcug

SEQ ID NO: 33263 - RNA, 333 nt, Artificial Sequence
  derived and/or modified sequence opt4 from anti-HIV_048-097107_VR-Chain
cagagcgugcugacccagccccccagcgugagcgccgcccccggccagaaggugaccaucagcugcagcggcagcagcagcaacaucgagaacaacuacgugagcugguacagacaggugcccggcaccgcccccaagcugcugaucuacaagaacgacaacagacccagcggcauccccgacagauucagcggcagcaagagcggcaccagcgccacccugggcaucaccggccugcagaccggcgacgaggccgacuacuacugcggcaucugggacaccagccugagcgccggcggcguguucggcaccggcaccaaggugaccgugcug

SEQ ID NO: 33264 - RNA, 333 nt, Artificial Sequence
  derived and/or modified sequence opt4 from anti-HIV_048-096871_VR-Chain
cagcccgugcugacccagccccccagcgccagcggcacccccggccagagagugaccaucagcugcagcggcagcagcagcaacaucggcagcaacuacguguacugguaccagcagcugcccggcaccacccccaagcugcugaucuacagaaacaaccagagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33265 - RNA, 333 nt, Artificial Sequence
  derived and/or modified sequence opt4 from anti-HIV_048-096668_VR-Chain
cagagcgugcugacccagccccccagcgugagcgccgcccccggccagaaggugaccaucagcugcagcggcagcggcagcaacaucggcaacaacuacgugagcugguaccagcagcugcccggcaccgcccccaagcugcugaucuacaagaacaccgagagacccagcggcauccccgacagauucagcggcagcaagagcggcaccagcgccacccuggacaucaccggccugcagaccggcgacgaggccgacuacuacugcggcaccugggacaccagccugagcgccggcggcguguucggcaccggcaccaaggugaccgugcug

SEQ ID NO: 33266 - RNA, 333 nt, Artificial Sequence
  derived and/or modified sequence opt4 from anti-HIV_048-095236_VR-Chain
cagagcgugcugacccagccccccagcgugagcgccccccccggccagaaggugaccaucagcugcagcggcaccaccagcaacaucggcagcaacuacguggccugguaccagcagcugcccggcaccgcccccaagcuggugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33267 - RNA, 333 nt, Artificial Sequence
  derived and/or modified sequence opt4 from anti-HIV_048-094155_VR-Chain
cagagcgugcugacccagccccccagcgugagcgccgcccccggccagaaggugaccgugagcugcagcggcagcagcagcgacaucggcgagaacuacgugagcugguaccagcaguuccccgagaccgcccccaagcugcugaucuacgacaacaacaagagacccagcggcauccccgacagauucagcggcagcaagagcggcaccagcgccacccuggccaucaccggccugcagaccggcgacgaggccgacuacuacugcggcaccugggacagcagccugagcgccggcggcguguucggcaccggcaccaaggugaccgugcug

SEQ ID NO: 33268 - RNA, 333 nt, Artificial Sequence
  derived and/or modified sequence opt4 from anti-HIV_048-093219_VR-Chain
cagccccugcugacccagccccccgccgugagcgccacccccggccagagagugaccaucagcugcaccggcagcagcagcaacaucggcagaaccuucgugaacugguaccagcagcugcccggcaccgcccccaagcugcugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33269 - RNA, 333 nt, Artificial Sequence
  derived and/or modified sequence opt4 from anti-HIV_048-092976_VR-Chain
cagagcgugcugacccagccccccagcgugagcgccgccagcggccagaaggugaccaucagcugcagcggcagcagcagcaacaucggcaacaacuacgugagcugguaccagcaccugcccggcaccgcccccaagcugcugaucuacaagaacgacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33270 - RNA, 333 nt, Artificial Sequence
  derived and/or modified sequence opt4 from anti-HIV_048-090866_VR-Chain
cagagcgugcugacccagccccccagcgugagcgccgcccccggccagaaggugaccaucagcugcagcggcagcagaagcaacaucggcagcaacuacaucagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccuacuacuacugcggcaccugggacaccagccugagcgccggcggcguguucggcagcggcaccaaggugaccgugcug

SEQ ID NO: 33271 - RNA, 333 nt, Artificial Sequence
  derived and/or modified sequence opt4 from anti-HIV_048-090650_VR-Chain
cagagcgcccugacccagcccgccagcgugagcggcagccugggccagagcaucaccaucagcugcagcggcagcagcagcaccaucggcaacaacuacgugagcugguaccaggugcugcccggcgccgcccccaagcugcugaucugcaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33272 - RNA, 333 nt, Artificial Sequence
  derived and/or modified sequence opt4 from anti-HIV_048-089009_VR-Chain
cagagcgugcugacccagccccccagcgugagcgccgcccccggccagaaggugaccaucagcugcagcggcggcagcagcaacaucggcaacaacuacgugagcugguaccagcagcugcccgagaccgcccccaagcugaucaucuacgacaacaacaagagacccagcggcauccacgacagauucagcggcagcaagagcggcaccagcgccacccuggacaucaccgcccugcagaccggcgacgaggccgacuacuacugcggcaccugggacaccagccugagcgccggcggcguguucggcaccggcaccaaggugaccgugcug

SEQ ID NO: 33273 - RNA, 333 nt, Artificial Sequence
  derived and/or modified sequence opt4 from anti-HIV_048-088654_VR-Chain
cagagcgcccugacccagcccagaagcgugagcgccgcccccggccagaaggugagcaucagcugcagcggcagaagcaccaaccugggcuacaacuacgugagcugguaccagcaccugcccggcgccgcccccaaggugcugaucuacgagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33274 - RNA, 333 nt, Artificial Sequence
  derived and/or modified sequence opt4 from anti-HIV_048-086513_VR-Chain
cagagcgcccugacccagccccccagcgugagcgccgcccccggccagaaggugaccaucagcugcagcggcagcaccagcaacaucggcaacaacuacgugagcugguaccagcagcugcccggcaccgcccccaagcugcugaucuacaagaacgacaacagacccagcggcauccccgacagauucagcagcagcaagagcggcaccagcgccacccugggcaucaccggccugcagaccggcgacgaggccgacuacuacugcggcaucugggacaccagccugagcgccggcggcguguucggcaccggcaccaaggugaccgugcug

SEQ ID NO: 33275 - RNA, 324 nt, Artificial Sequence
  derived and/or modified sequence opt4 from anti-HIV_048-086024_VR-Chain
cuggcccagccccccagcgugagcggcacccccggccagagagugaccaucagcugcagcggcagcagcagcaacaucggcagcaacgccgugaacugguaccagcaguuccccggcaccgcccccaagcugcugaucuacgacaccgacaagagacccagcggcauccccgacagauucagcggcagcaagagcggcaccagcgccauccugggcaucaccggccugcagaccggcgacgaggccgacuacuacugcggcgccugggacaccagccugagcgccggcggcguguucggcaccggcaccaaggugaccgugcug

SEQ ID NO: 33276 - RNA, 333 nt, Artificial Sequence
  derived and/or modified sequence opt4 from anti-HIV_048-085857_VR-Chain
cagagcgcccugacccagcccagaagcgugagcggcagccugggccagagcgugaccaucagcugcaccggcaccaccagcgacgugggcuucgacuacgugagcugguaccaggugcugcccggcaccgcccccaagcugcugaucuacaagaacgacaagagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33277 - RNA, 333 nt, Artificial Sequence
  derived and/or modified sequence opt4 from anti-HIV_048-084277_VR-Chain
cagagcgugcugagacagccccccagccugagcggcgcccccggccagagagugacccugagcugcaccggcagcagcagcaacaucggcggcuacgacgugcacugguaccagcacgugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33278 - RNA, 333 nt, Artificial Sequence
  derived and/or modified sequence opt4 from anti-HIV_048-084245_VR-Chain
cagagcacccugacccagccccccagcgugagcgccgcccccggccagaaggugaccaucagcugcagcggcagcaacagcaacaucggcaagcacuacgugagcugguaccagcaguuccccggcgccgugcccaagcugcugaucuacgagaacaagaagagacccagcggcauccccgacagauucagcggcagcaagagcgacaccagcgccacccuggacaucaccggccugcagaccggcgacgaggccgacuacuacugcggcaccugggacaccagccugagcgccggcggcguguucggcagcggcaccaaggugaccgugcug

SEQ ID NO: 33279 - RNA, 333 nt, Artificial Sequence
  derived and/or modified sequence opt4 from anti-HIV_048-082487_VR-Chain
cagagccugcugacccagccccccagcgugagcgccgcccccggccagaaggugaccaucagcugcagcggcagcagcagcaccaucggcaacaacuacgugagcugguaccaggugcugcccggcgccgcccccaagcugcugaucugcaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33280 - RNA, 333 nt, Artificial Sequence
  derived and/or modified sequence opt4 from anti-HIV_048-081787_VR-Chain
cagagcgugcugacccagccccccagcgugagcggcgcccccggccagagagugaccaucagcugcaccggcagcagcagcaacaucggcagcuacgacgugcacugguaccagcagcugcccggcaccgcccccaagcugcugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcggcggcggcguguucggcaccggcaccaaggugaccgugcug

SEQ ID NO: 33281 - RNA, 333 nt, Artificial Sequence
  derived and/or modified sequence opt4 from anti-HIV_048-081062_VR-Chain
cagagcgugcugacccagccccccagcgugagcgccgcccccggccagaaggugaccaucagcugcagcggcaccagcagcaacaucggcgccaacuacgugagcugguaccagcaggugcccggcaccgcccccaagcugcugaucuacgagaacaacaagagacccagcggcacccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33282 - RNA, 333 nt, Artificial Sequence
  derived and/or modified sequence opt4 from anti-HIV_048-079639_VR-Chain
cagagcgugcugacccagccccccagcgugagcgccgcccccggccagaaggugaccaucagcugcagcggcagcagcagcaacaucggcaagaacuacgugagcugguaccagcaccugcccggcaccgcccccaagcugcugaucuacgagaacaacaagagacccagcggcauccccgacagauucagcggcagcaagagcggcaccgccgccacccugggcaucaccggccugcagaccggcgacgaggccggcuacuacugcggcaccugggacaccagccugagcgccggcggcguguucggcaccggcaccaaggugaccgugcug

SEQ ID NO: 33283 - RNA, 333 nt, Artificial Sequence
  derived and/or modified sequence opt4 from anti-HIV_048-079126_VR-Chain
cagagcgugcugacccagccccccagcgugagcgccgcccccggccagaaggugaccaucagcugcagcggcagcagcagcaacaucggcaacaacuacgugagcugguaccagcaccugcccggcaccccccccaagcugcugaucuucaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33284 - RNA, 333 nt, Artificial Sequence
  derived and/or modified sequence opt4 from anti-HIV_048-073118_VR-Chain
cagagcgugcugacccagccccccagcgugagcgccgcccccagacacaacgugaccaucagcugcagcggcggcagcagcaacaucggcaacaacuucgugagcugguaccaguaccugcccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcgccaccugggacaccagccugagcgccggcggcguguucggcaccggcaccaaggugaccgugcug

SEQ ID NO: 33285 - RNA, 333 nt, Artificial Sequence
  derived and/or modified sequence opt4 from anti-HIV_048-070264_VR-Chain
cagagcgugcugacccagagccccagcgugagcgccgcccccggccagaaggugaccaucagcugcagcggcaccagcagcaacaucggcaacaccuacgugagcugguaccagcagcugcccggcaccgcccccaagcugcugaucuacaagaacgacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33286 - RNA, 333 nt, Artificial Sequence
  derived and/or modified sequence opt4 from anti-HIV_048-069426_VR-Chain
cagagcgugcugacccagccccccagcgugagcgccgcccccggccagaaggugaccaucagcugcagcggcagcagcagcaccaucggcaacaacuacgugagcugguaccagcagcugcccggcaccgcccccaagcugcugaucuacaagaacaacaagagacccagcggcgugcccgacagauucagcggcagcaagagcggcaccagcgccacccccggcaucaccggccugcagaccggcgacgaggccgacuacuacugcggcaccugggacaccagccugagcgccggcggcguguucggcaccggcaccaaggugaccgugcug

SEQ ID NO: 33287 - RNA, 333 nt, Artificial Sequence
  derived and/or modified sequence opt4 from anti-HIV_048-068564_VR-Chain
cagagcgcccugacccagcccagaagcgugagcggcagccccggccagagcguggccaucagcugcaccggcaccagcagcgacgugggcuacaacuacgugagcugguaccaggugcugcccggcaccgcccccaagcugcugaucuacaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33288 - RNA, 333 nt, Artificial Sequence
  derived and/or modified sequence opt4 from anti-HIV_048-068345_VR-Chain
cagagcgugcugacccagacccccagcgugagcgccgcccccggccagagagugaccaucagcugcagcggcagcaccagcaacaucggcaacaacuacgugagcugguaccagcagcugcccggcaccgcccccaagcugcugaucuacgagaacaacaagagacccagcggcaucagagacagauucagcgccagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33289 - RNA, 333 nt, Artificial Sequence
  derived and/or modified sequence opt4 from anti-HIV_048-067337_VR-Chain
cagagcgugcugacccagccccccagcgugagcgccgcccccggccagaaggugaccaucagcugcagcggcgccagcuacaacaucggcaagaacagcgugagcugguaccagcagcugcccggcaccgcccccaagcugcugaucuacaagaacgacaagagacccagcggcauccccgacagauucagcggcagcaagagcggcgccagcgccacccuggacaucaccggccugcagaccggcgacgaggccgacuacuacugcggcaucugggacaccagccugagcgccggcggcguguucggcaccggcaccaaggugaccgugcug

SEQ ID NO: 33290 - RNA, 333 nt, Artificial Sequence
  derived and/or modified sequence opt4 from anti-HIV_048-067180_VR-Chain
cagagcgugcugacccagccccccagcgugagcgccgcccccggccagaaggugaccaucagcugcagcggcagcagccccaacaucggcaacaacuacgugagcugguaccagagacugcccggcaccgcccccaagcugcugaucuacgagaacgaccagagacccagcggcauccccgacagaaucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33291 - RNA, 333 nt, Artificial Sequence
  derived and/or modified sequence opt4 from anti-HIV_048-063017_VR-Chain
cagagcgugcugacccagccccccagcgugagcgccgcccccggccagaaggugaccaucagcugcagcggcagcagcagcaacaucggcaacaacuacgugagcugguaccagcaccaccccggcaaggcccccaagcugaugaucuacgaggugagcaagagacccagcggcauccccgacagauucagcggcagcaagagcggcaccagcgccacccugggcaucaccggccugcagaccggcgacgaggccgacuacuacugcggcaccugggacaccagccugaacagaggcggcguguucggcaccggcaccaaggugaccgugcug

SEQ ID NO: 33292 - RNA, 333 nt, Artificial Sequence
  derived and/or modified sequence opt4 from anti-HIV_048-061885_VR-Chain
cagagcgugcugacccagccccccagcgugagcgccgcccccggccagaaggugaccaucagcugcagcggcagcagcagcaacaucggcagccacuacaucagcugguaccagcaguuccccggcgccgcccccaagcugcugaucuacgagaacgacaagagacccagcggcauccccgacagauucagcgccagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33293 - RNA, 333 nt, Artificial Sequence
  derived and/or modified sequence opt4 from anti-HIV_048-061671_VR-Chain
cagagcgugcugacccagccccccagcgccagcggcacccccggccagagagugaccaucagcugcagcggcagcagaagcaacaucggcagcaacuacguguacugguaccagcaguuccccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcgccaccugggacaccagccugagcgccggcggcguguucggcaccggcaccaaggugaccgugcug

SEQ ID NO: 33294 - RNA, 333 nt, Artificial Sequence
  derived and/or modified sequence opt4 from anti-HIV_048-060700_VR-Chain
cagagcgugcugacccagcugcccagccugagcgccgcccccggccagaaggugaccaucagcugcagcggcagcagcagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgaguacuacugcgccaccugggacgccagccugagcggcggcggcguguucggcaccggcaccaaggugaccgugcug

SEQ ID NO: 33295 - RNA, 333 nt, Artificial Sequence
  derived and/or modified sequence opt4 from anti-HIV_048-060592_VR-Chain
cagagcgugcugacccagccccccagcgugagcgccgcccccggccagaaggugaccaucagcugcagcggcagcagcagcaacaucggcaagaacuacgugagcugguaccagcaguuccccggcaccgcccccaagcugcugaucuacgagaacaacaagagacccagcggcauccccgacagauucagcgccagcaagagcgccaccagcgccacccuggugaucaccggccugcagaccggcgacgaggccguguacuacugcggcaccugggacaccagccugagcgccggcggcguguucggcagcggcaccaaggugaccgugcug

SEQ ID NO: 33296 - RNA, 333 nt, Artificial Sequence
  derived and/or modified sequence opt4 from anti-HIV_048-060300_VR-Chain
cagcccgugcugacccagccccccagcgccagcggcacccccggccagagagugaccaucagcugcagcggcagcagcagcaacaucggcaccaacaccgugaacugguaccagcaguuccccggcaccgcccccaagcugcugaucuacaagaacaacgagagacccagcggcauccccgacagauucagcggcagcaagagcggcaccagcgccacccugggcaucaccggccugcagaccggcgacgaggccgacuacuacugcggcaccugggacaccagccugagcggcggcggcguguucggcaccggcaccaaggugaccgugcug

SEQ ID NO: 33297 - RNA, 333 nt, Artificial Sequence
  derived and/or modified sequence opt4 from anti-HIV_048-059141_VR-Chain
cagcccgugcugacccagccccccagcgccagcggcacccccggccagagagugagcaucagcugcagcggcaacuucagcaacaucggcagcaaguacguguacugguaccagcagauccccggcaccgcccccaacgugaucaucuacagaaccaaccugagacccagcggcauccccgacagauucagcgccagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33298 - RNA, 333 nt, Artificial Sequence
  derived and/or modified sequence opt4 from anti-HIV_048-057777_VR-Chain
cagagcgugcugacccagccccccagccugagcgccgcccccggccagagagugaccaucagcugcagcggcagcagcagcaacaucggcaacaacuacgugagcugguaccagcaguuccccggcaccgcccccacccugcugaucuacgagaacgacaagagacccagcggcauccccgacagauucagcgccagcaagagcggcaccagcgccacccugggcaucaccggccugcaggccggcgacgaggccgacuacuacugcggcaccugggacaccagccugagcgccggcggcguguucggcaccggcaccaaggugaccgugcug

SEQ ID NO: 33299 - RNA, 333 nt, Artificial Sequence
  derived and/or modified sequence opt4 from anti-HIV_048-056928_VR-Chain
cagagcgugcugacccagccccccagcgugagcgccgcccccggccagaaggugaccaucagcugcagcggcagcagcagcaccaucggcaacaacuacgugagcugguaccagcugcugcccggcaccgcccccaagcugcugaucuacgacaacgacaacagacccagcgacauccccgacagauucagcggcagcaagagcggcaccagcgccacccugggcaucaccggccugcagaccggcgacgaggccgacuacuacugcggcgccugggacaccagccugagcgccggcggcguguucggcaccggcaccaaggugaccgugcug

SEQ ID NO: 33300 - RNA, 333 nt, Artificial Sequence
  derived and/or modified sequence opt4 from anti-HIV_048-056131_VR-Chain
caguucgugcugacccagcccgccagcgugagcggcagccccggccagagcaucaccaucagcugcagcggcaccagcagcgacgugggcuacaacuacgugagcugguaccagcagcugcccggcaccgcccccaagcugcugaucuacgagaacaccaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33301 - RNA, 333 nt, Artificial Sequence
  derived and/or modified sequence opt4 from anti-HIV_048-055864_VR-Chain
cagagcgugcugacccagccccccagcgugagcguggcccccggccagaaggugaccaucuacugcagcggcagcagcagcaacaucggcaagaacagcgugagcugguacgugcaggugcccggcaccgcccccaaguuccugaucuacgagaacaaccagagacccagcggcaucagcgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 33302 - RNA, 333 nt, Artificial Sequence
  derived and/or modified sequence opt4 from anti-HIV_048-055094_VR-Chain
cagagcgugcugacccagccccccagcgugagcggcgcccccggccagagagugaccaucagcugcagcgccagcagcagcagcaucggcaacgacuucgugagcugguaccagcagcugcccggcaccgcccccaagcugcugaucagcgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33303 - RNA, 333 nt, Artificial Sequence
  derived and/or modified sequence opt4 from anti-HIV_048-054343_VR-Chain
cagagcgugcugacccagccccccagcgugagcggcgcccccggccagagagugaccaucagcugcaccggcagcagcagcaacaucggcggcuacgacgugaacugguaccagcagcugcccggcaccgcccccaagcugcugaucuucaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33304 - RNA, 333 nt, Artificial Sequence
  derived and/or modified sequence opt4 from anti-HIV_048-054193_VR-Chain
cagagcgugcugacccagccccccagcgugagcgccgcccccggccagaaggugaccaucagcugcagcggcggcagcagcaacaucggcaacaacuacgugagcugguaccaccaggugcccggcaccgcccccaagcugcugaucuucgagaacaacaagagacccagcggcauccccgacagauucagcggcagcaagagcggcaccagcgccacccugggcaucaccggccugcagaccggcgacgaggccgacuacuacugcggcaccugggacaccagccugagcggcggcggcguguucggcaccggcaccaaggugaccgugcug

SEQ ID NO: 33305 - RNA, 333 nt, Artificial Sequence
  derived and/or modified sequence opt4 from anti-HIV_048-052521_VR-Chain
cagagcgugcugacccagccccccagcgugagcgccgcccccggccagaaggugaccaucagcugcagcggcagcagcagcaacaucggcagacacagcgugagcugguaccagcagcugcccggcaccgcccccaagcugcugaucuacgacaccgacaagagacccagcggcauccccgacagauucagcggcagcaagagcggcaccagcgccacccugggcaucaccggccugcagaccggcgacgaggccgacuacuacugcggcaccugggacaccagccugagcggcggcggcguguucggcaccggcaccaaggugaccgugcug

SEQ ID NO: 33306 - RNA, 333 nt, Artificial Sequence
  derived and/or modified sequence opt4 from anti-HIV_048-049037_VR-Chain
cagagcgugcugacccagccccccagcgugagcgccgcccccggccagaaggugaccaucagcugcagcggcagcagcuucaacaucggcaacaacuacgugagcugguaccagcaccugcccggcaccgcccccaagcugcugaucuacgccgccgugaccagacccagcggcauccccgacagauucagcggcagcaagagcggcaccagcgccacccuggacaucaccggccugcagaccggcgacgaggccgacuacuacugcggcaccugggacaccagccugagcgccggcggcguguucggcaccggcaccaaggugaccgugcug

SEQ ID NO: 33307 - RNA, 333 nt, Artificial Sequence
  derived and/or modified sequence opt4 from anti-HIV_048-048720_VR-Chain
cagagcgugcugacccagccccccgccgugagcgccgcccccggccagagaguggccaucagcugcagcggcaccagcagcaacaucggcagcaaccuggugagcugguaccagcagcugcccggcaaggcccccagacugcugaucuacgacaacuacaagagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33308 - RNA, 333 nt, Artificial Sequence
  derived and/or modified sequence opt4 from anti-HIV_048-048542_VR-Chain
cagagcgugcugacccagccccccagcgugagcgccgcccccggccagaaggugaccaucagcugcagcggcagcagcagcaacaucggcaacaacuucgugagcugguaccagcagcugcccggcaccgcccccaagcugcugaucuacaacaacgacagaagacccagcggcgugcccgacagauucagcgccagcaaguucggcaccgccgccacccugggcaucaccggccugcagaccggcgacgaggccgacuacuacugcggcaccugggacagcagccugagcgccggcggcguguucggcaccggcaccaaggugaccgugcug

SEQ ID NO: 33309 - RNA, 333 nt, Artificial Sequence
  derived and/or modified sequence opt4 from anti-HIV_048-047777_VR-Chain
cagagcgugcugacccagccccccagcgccagcggcacccccggccagagagugaccaucagcugcagcggcagcagcgccaacaucggcaccaacuacguguucugguaccagcaccugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33310 - RNA, 333 nt, Artificial Sequence
  derived and/or modified sequence opt4 from anti-HIV_048-046841_VR-Chain
cagagcgugcugacccagccccccagcgugagcgccgcccugggccagaaggugaccaucaccugcagcggcgacaacggcaacaucggcuaccacuacgugagcugguaccagcaggugggcagagccgcccccaagcugcugaucuacgccaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33311 - RNA, 333 nt, Artificial Sequence
  derived and/or modified sequence opt4 from anti-HIV_048-046202_VR-Chain
cagagcgugcugacccagccccccagcgugagcgccgcccccggccagaaggugaccaucagcugcagcggcagcagcagcaacaucggcaacaacuacgugagcugguaccagcaccugcccggcaccgcccccaagcugcugaucuacgacaccuacaagagacacagcggcgugcccgacagauucagcaacagcaagagcggcaccagcgccacccuggccaucaccggccugcagaccggcgacgagggcgacuacuacugcggcgccugggacaccagccugagcgccggcggcguguucggcaccggcaccaaggugaccgugcug

SEQ ID NO: 33312 - RNA, 333 nt, Artificial Sequence
  derived and/or modified sequence opt4 from anti-HIV_048-046059_VR-Chain
cagagcgugcugacccagccccccagcgugagcgccgcccccggccagaacgugaccaucagcugcagcggcaccagcagcaacaucgagaacaacuacgugagcugguaccagacccugcccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33313 - RNA, 333 nt, Artificial Sequence
  derived and/or modified sequence opt4 from anti-HIV_048-043568_VR-Chain
cagagcgugcugacccagccccccagcgugagcgccgcccccggccagaaggugaccaucagcugcagcggcagcgacagcaacaucggcagcaacuacgugagcugguaccagcagcugcccggcgccgcccccaagcugcugaucuacaagaacaacaacagacccagcggcauccccgacagauucagcggcagcaagagcggcaccagcgccacccugggcaucagcggccugcagaccggcgacgaggccgacuacuacugcggcaccugggacaccagccugagcggcggcggcguguucggcaccggcaccaaggugaccgugcug

SEQ ID NO: 33314 - RNA, 333 nt, Artificial Sequence
  derived and/or modified sequence opt4 from anti-HIV_048-042713_VR-Chain
cagagcgugcugacccagccccccagcgugagcgccgcccccggccagaaggugaccaucagcugcagcggcagcagcagcaacaucggcagacacuacgugagcugguaccagcagcugcccggcaccgcccccaagcugcugaucuacgacaacaacagcagacccagcggcauccccgacagauucagcggcagcaagagcggcaccagcgccacccugggcaucaccggccugcagaccggcgacgaggccgacuacuacugcggcaccugggacaccagccugaacagaggcggcguguucggcaccggcaccaaggugaccgugcug

SEQ ID NO: 33315 - RNA, 333 nt, Artificial Sequence
  derived and/or modified sequence opt4 from anti-HIV_048-042440_VR-Chain
cagagcgugcugacccagccccccagcgccagcggcacccccggccagagagugaccaucagcugcagcggcagcagcagcaacaucggcaccaacaccgugaacugguaccagcagcugcccggcaccgcccccaagcugcugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33316 - RNA, 333 nt, Artificial Sequence
  derived and/or modified sequence opt4 from anti-HIV_048-040511_VR-Chain
cagagcgugcugacccagccccccagcgugagcgccgcccccggccagaaggugaccaucagcugcagcggcagcagcagcaacaucggcaacaacuacgugagcugguaccagcaccugcccggcaccgcccccaagcugcugaucuacgagaacaacaagagaagcagcggcauccccgagagauucagcggcagccagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33317 - RNA, 333 nt, Artificial Sequence
  derived and/or modified sequence opt4 from anti-HIV_048-039195_VR-Chain
cagagcgugcugacccagccccccagcgugagcgccgcccccggccagagagugaccaucagcugcagcggcagcaccagcaacaucggcaaccacuacgugagcugguaccagcagcugcccggcaccgcccccaagcugcugaucuacgacaacggcaacagacccagcggcauccccgacagauucagcggcagcaagagcggcaccagcgccacccuggacaucaccggccugcagaccggcgacgaggccgacuacuacugcggcaccugggacaccagccugaacagaggcggcguguucggcaccggcaccaaggugaccgugcug

SEQ ID NO: 33318 - RNA, 333 nt, Artificial Sequence
  derived and/or modified sequence opt4 from anti-HIV_048-036935_VR-Chain
cagagcgugcugacccagccccccagcaugagcgccgcccccggcgagagagugaccaucagcugcaccggcagcagcagcaacaucggcggcuacgacgugcacugguaccagcagcugcccggcaucgcccccaagauccugaucuacagaaacagcaucagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33319 - RNA, 333 nt, Artificial Sequence
  derived and/or modified sequence opt4 from anti-HIV_048-034478_VR-Chain
cagagcgugcugacccagccccccagcgugagcgccgcccccggccagaaggugaccaucagcugcaccggcagcggcagcaacaucggcaacaacgacgugagcugguaccagcagcugcccggcaccgcccccagacugcugaucuacggcgacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33320 - RNA, 333 nt, Artificial Sequence
  derived and/or modified sequence opt4 from anti-HIV_048-031641_VR-Chain
cagagcgugcugacccagccccccagcgugagcgccgcccccggccagaaggugaccaucagcugcagcggcaacaacagcaacaucggcaacaacuacgugagcugguaccagcagcugcccggcaccgcccccaagcugcugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33321 - RNA, 333 nt, Artificial Sequence
  derived and/or modified sequence opt4 from anti-HIV_048-029760_VR-Chain
cagagcgcccugacccagcccgccagcgugagcggcagcagcggccagagcaucaccaucagcugcaccggcaccaacagcgacgugggcuacgacuacgugugcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33322 - RNA, 333 nt, Artificial Sequence
  derived and/or modified sequence opt4 from anti-HIV_048-027970_VR-Chain
cagagcgugcugacccagccccccagcgugagcgccccccccggccagaaggugaccaucagcugcagcggcaccaccagcaacaucggcagcaacuacguggccugguaccagcaguuccccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcgccaccugggacaccagccugagcgccggcggcguguucggcaccggcaccaaggugaccgugcug

SEQ ID NO: 33323 - RNA, 333 nt, Artificial Sequence
  derived and/or modified sequence opt4 from anti-HIV_048-027337_VR-Chain
cagagcgugcugacccagccccccagcgugagcgccgcccccggccagaaggugaccaucagcugcagcggcagcuacagcaacaucggcaacaacuaccugagcugguaccagcagcugcccggcaccgcccccaagcugcugaucuacaagaacaacaagagacccagcggcgugcccgacagauucagcggcagcaagagcggcgccagcgccacccuggacaucaccggccugcagaccggcgacgaggccgacuacuacugcggcaucugggacaccagccugagcgccggcggcguguucggcaccggcaccaaggugaccgugcug

SEQ ID NO: 33324 - RNA, 333 nt, Artificial Sequence
  derived and/or modified sequence opt4 from anti-HIV_048-027217_VR-Chain
cagagcgugcugacccagccccccagcgugagcgccgcccccggccagaaggugaccaucagcugcagcggcagcagcagcaucaucggcaacaacuacgugagcugguaccagcagcugcccggcaccgcccccaagcugcugaucuacgagaacaacaagagacccagcggcauccccgacagauucagcggcagcaagagcggcaccagcgccacccuggccaucgccggccugcagaccggcgacgaggccgacuacuacugcgccaccugggacaccagccugagcgccggcggcguguucggcaccggcaccaaggugaccgugcug

SEQ ID NO: 33325 - RNA, 333 nt, Artificial Sequence
  derived and/or modified sequence opt4 from anti-HIV_048-026760_VR-Chain
cagagcgugcugacccagccccccagcgugagcgccgcccccggccagaaggugaccaucagcugcagcggcagcagcagcaacaucggcaacaacuacgugagcugguaccagcaccugcccggcaccgcccccaagcugcugaucuacgacaccgugaagagacacagcggcgugcccgacagauucagcggcagcaagagcggcaccagcgccacccugggcaucagcggccugcagaccggcgacgaggccgacuacuacugcggcaccugggacaccagccugagcgccggcggcguguucggcagcggcaccaaggugaccgugcug

SEQ ID NO: 33326 - RNA, 333 nt, Artificial Sequence
  derived and/or modified sequence opt4 from anti-HIV_048-024800_VR-Chain
cagagcgugcugacccagccccccagcgugagcgccgcccccggccagaaggugaccaucagcugcagcggcagcuacagcaacaucggcaacaacuacgugagcugguaccaggugcugcccggcaccgcccccaagcugcugaucuacaagaacaacgagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33327 - RNA, 333 nt, Artificial Sequence
  derived and/or modified sequence opt4 from anti-HIV_048-024313_VR-Chain
cagagcgugcugacccagccccccagcgugagcgccgcccccggccagaaggugaccaucagcugcagcggcagcagcagcaccaucggcaacagccacgugagcugguaccagauccugcccggcaccgcccccaagcugcugaucuacaaggacgacaagagacccagcggcauccccgacagauucagcggcagcaagagcggcaccagcgccacccugggcaucaccggccugcagaccggcgacgaggccgacuacuacugcggcaccugggacaccagccugaacagaggcggcguguucggcaccggcaccaaggugaccgugcug

SEQ ID NO: 33328 - RNA, 333 nt, Artificial Sequence
  derived and/or modified sequence opt4 from anti-HIV_048-021748_VR-Chain
cagagcgugcugacccagccccccagcgugagcgccgcccccggccagagagugaccaucagcugcagcggcagcaccagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccugggcaucagcggccugcagaccggcgacgaggccgacuacuacugcggcaccugggacagcagccugagcggcggcggcguguucggcaccggcaccaaggugaccgugcug

SEQ ID NO: 33329 - RNA, 333 nt, Artificial Sequence
  derived and/or modified sequence opt4 from anti-HIV_048-020991_VR-Chain
cagagcgugcugacccagccccccagcgccagcggcacccccggccagaaggugaccaucagcugcagcggcagcagcagcaccaucggcaacaacuacgugagcugguaccaggugcugcccggcaccgcccccaagcugcugaucuacaagaacgacaagagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33330 - RNA, 333 nt, Artificial Sequence
  derived and/or modified sequence opt4 from anti-HIV_048-020340_VR-Chain
cagagcgugcugacccagccccccagcgugagcgccgcccccggccagagagugaccaucagcugcagcggcagcagcagcaacgugggcaacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacgccagccugagcgccggcggcguguucggcaccggcaccaaggugaccgugcug

SEQ ID NO: 33331 - RNA, 333 nt, Artificial Sequence
  derived and/or modified sequence opt4 from anti-HIV_048-019993_VR-Chain
cagagcgugcugacccagccccccagcgugagcggcgcccccggccagagagugaccaucagcugcaccggcagcagcagcagcaucggcggcuucgacgugcacugguaccagagacugcccggcaccgcccccagacugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33332 - RNA, 333 nt, Artificial Sequence
  derived and/or modified sequence opt4 from anti-HIV_048-019947_VR-Chain
cagagcgugcugacccagccccccagcgugagcgccgcccccggccagagagugaccaucagcugcagcggcagcagcagcaacaucggcagcaaguacgugagcugguaccagcagcugcccggcaccgcccccaagcugcugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcaccggcggcguguucggcaccggcaccaaggugaccgugcug

SEQ ID NO: 33333 - RNA, 333 nt, Artificial Sequence
  derived and/or modified sequence opt4 from anti-HIV_048-017871_VR-Chain
cagagcgugcugacccagccccccagcgugagcgccgcccccggccagaaggugaccaucagcugcagcggcagcagcagcaacaucggcaacagauacgugagcugguaccagcagcugcccggcaccgcccccaagcugcugaucuacaagaacaacaagagacccagcggcauccccgacagauucagcggcagcaagagcggcaccagcgccacccugggcaucaccggccugcagaccggcgacgaggccgacuacuacugcggcaccugggacggcagccugagcaccggcggcgugaucggcaccggcaccaaggugaccgugcug

SEQ ID NO: 33334 - RNA, 333 nt, Artificial Sequence
  derived and/or modified sequence opt4 from anti-HIV_048-015931_VR-Chain
cagagcgugcugacccagccccccagcgugagcgccgcccccggccagaaggugaccaucagcugcagcggcggcagcagcaacaucggcagcaccuacgugagcugguaccagcaggugcccggcaccgcccccaagcugcugaucuacgagaacaacaagagacccagcggcauccccgacagauucagcggcagcaagagcggcaccagcgccacccuggacaucaccggccugcagaccggcgacgaggccgacuacuacugcggcaccugggacaccagccugagcggcggcggcguguucggcaccggcaccaaggugaccgugcug

SEQ ID NO: 33335 - RNA, 333 nt, Artificial Sequence
  derived and/or modified sequence opt4 from anti-HIV_048-015920_VR-Chain
cagagccugcugacccagccccccagcgugagcgccgcccccggccagaaggugaccaucagcugcagcggcagcagcagcaccaucggcaacaacuacgugagcugguaccaggugcugcccggcaccgcccccaagcugcugaucuacaagaacaacgagagacccagcggcauccccgacagauucagcggcagcaagagcggcaccagcgccacccugggcaucaccggccugcagaccggcgacgaggccgaguacuacugcgccaccugggacgccagccugagcggcggcggcguguucggcaccggcaccaaggugaccgugcug

SEQ ID NO: 33336 - RNA, 333 nt, Artificial Sequence
  derived and/or modified sequence opt4 from anti-HIV_048-013898_VR-Chain
cagagcgugcugacccagccccccagcgugagcgccgcccccggccagaaggugaccaucagcugcagcggcagcagcagcaacaucggcaagcacagcgugagcugguaccagcagcugcccggcaccgcccccgagcugcugaucuacgacaacaacaacagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33337 - RNA, 333 nt, Artificial Sequence
  derived and/or modified sequence opt4 from anti-HIV_048-013429_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccacccugcugaucuacgagaacgacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33338 - RNA, 333 nt, Artificial Sequence
  derived and/or modified sequence opt4 from anti-HIV_048-012358_VR-Chain
cagagcgugcugacccagccccccagcgugagcgccgcccccggccagaaggugaccaucagcugcagcggcagcaacagcgccaucggcaacaacuacgugagcugguaccaggugcugcccggcaccgcccccaagcugcugaucuacaagaacaacgagagacccagcggcauccccgacagauucagcggcagcaagagcggcaccagcgccacccuggacaucaccggccugcagaccggcgacgaggccgacuacuacugcggcaccugggacaccagccugagcgccggcggcguguucggcaccggcaccaaggugaccgugcug

SEQ ID NO: 33339 - RNA, 333 nt, Artificial Sequence
  derived and/or modified sequence opt4 from anti-HIV_048-011158_VR-Chain
cagagcgugcugacccagccccccagcgugagcgccgcccccggccagaaggugaccaucagcugcagcggcaucagcagcaacaucggcaacaacgacgugagcugguaccagcagcugcccggcaccgcccccaagcugcugaucuacgacaacgacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33340 - RNA, 333 nt, Artificial Sequence
  derived and/or modified sequence opt4 from anti-HIV_048-010720_VR-Chain
cagagcgugcugacccagccccccagcgugagcgccgcccccggccagaaggugaccaucagcugcagcggcagcagcagcaacaucggcagccacuacgugagcugguaccagcaggugcccggcaccgcccccagacuggugaucuacgagaacagcaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcagcggcaccaaggugaccgugcug

SEQ ID NO: 33341 - RNA, 333 nt, Artificial Sequence
  derived and/or modified sequence opt4 from anti-HIV_048-009445_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgugcccaagcugcugaucuacgacaccuacaccagacccagcggcacccccgacagauucagcggcagcaagagcggcaccagcgccacccuggccaucaccggccugcagaccggcgacgaggccgacuacuacugcggcaccugggacggcagccugagcaccggcggcgugaucggcaccggcaccaaggugaccgugcug

SEQ ID NO: 33342 - RNA, 324 nt, Artificial Sequence
  derived and/or modified sequence opt4 from anti-HIV_048-006126_VR-Chain
cagagcgugcugacccagccccccagcgugagcggcgcccccggccagaaggugaccaucagcugcagcggcaucagcagcaacuucggcaucagcugguaccagcaggugcccggcaccgcccccaagcugcugaucuacgagaacgacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33343 - RNA, 333 nt, Artificial Sequence
  derived and/or modified sequence opt4 from anti-HIV_048-005652_VR-Chain
cagagcgugcugacccagccccccagcgugagcgccgcccccggccagaaggugaccaucagcugcagcggcagcaacagcgccaucggcaacaacuacgugagcugguaccaggugcugcccggcaccgcccccaagcugcugaucuacgacaccuacaagagagccagcggcauccccgacagauucagcggcagcaagagcggcaccagcgccacccugggcaucaccggccugcagaccggcgacgaggccgacuacuacugcggcaccugggacaccagccugagcggcggcggcguguucggcaccggcaccaaggugaccgugcug

SEQ ID NO: 33344 - RNA, 333 nt, Artificial Sequence
  derived and/or modified sequence opt4 from anti-HIV_048-005532_VR-Chain
cagagcgugcugacccagccccccagcgugagcgccgcccccggccagaaggugaccaucagcugcagcggcaccagcagcaacaucggcaacaccuacgugagcugguaccagcagcugcccggcaccgcccccaacuaccugaucuacaagaucgacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33345 - RNA, 333 nt, Artificial Sequence
  derived and/or modified sequence opt4 from anti-HIV_048-005189_VR-Chain
cagagcgugcugacccagccccccagcgugagcgccgcccccggccagaaggugaccaucagcugcagcggcagcggcagcaccaucggcaacaacgacgugagcugguaccagcagcugcccggcgccgcccccaagcugcugaucuacgaggacaacaagagacccagcggcauccccgccagauucagcggcagcaagagcggcaccagcgccacccugagaaucaccggccugcagaccggcgacgaggccgacuacuacugcggcaccugggacagcagccugagcgccggcggcguguucggcaccggcaccagagugagcgugcug

SEQ ID NO: 33346 - RNA, 333 nt, Artificial Sequence
  derived and/or modified sequence opt4 from anti-HIV_048-005088_VR-Chain
cagagcgugcugacccagccccccagcgugagcgccgcccccggccagaaggugaccaucagcugcagcggcagcagcagcaacaucggcaagaacuacgugagcugguaccagcagcugcccggcaccgcccccaagcugcugaucuacgacaacaacaacagacccagcggcauccccgacagauucagcggcagcaagagcggcaccagcgccacccugggcaucaccggccugcagaccggcgacgaggccgacuacuacugcggcgccugggacaccagccugagcgccggcggcguguucggcaccggcaccaaggugaccgugcug

SEQ ID NO: 33347 - RNA, 333 nt, Artificial Sequence
  derived and/or modified sequence opt4 from anti-HIV_048-004023_VR-Chain
cagagcgugcugacccagccccccagcgugagcgccacccccggccagaaggugaccaucagcugcagcggcggcagcagcaacaucggcaagaacgacgugagcugguaccagcagcugcccggcaccgcccccaagcugcugaucuacgacaccaacaagagacccagcggcauccccgacagauucagcgccgccagaagcggcaccagcgccacccuggacaucaccggccugcagaccggcgacgaggccgacuacuacugcggcaccugggacaccagccugagcgccggcggcguguucggcaccggcaccaaggugaccgugcug

SEQ ID NO: 33348 - RNA, 333 nt, Artificial Sequence
  derived and/or modified sequence opt4 from anti-HIV_048-001580_VR-Chain
cagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugcuguacgagaacaacaagagacccagcggcauccccgacagauucagcggcagcaagagcggcaccagcgccacccuggccaucaccggccugcagaccggcgacgaggccgccuacuacugcggcaccugggacggcagccugagcaccggcggcgugaucggcaccggcaccaaggugaccgugcug

SEQ ID NO: 33349 - RNA, 333 nt, Artificial Sequence
  derived and/or modified sequence opt4 from anti-HIV_038-221120_VR-Chain
cagagcgugcugacccagccccccagcgugagcgccgcccccggccagaaggugaccaucagcugcagcggcagcaccagcaacaucggcaagaacuacgugagcugguaccagcagcugcccggcaccgcccccaagcugcugaucuacgacaacaacgagagacccagcggcauccccgacagauucagcggcagcaagagcggcaccagcgccacccugggcaucaccggccugcagaccggcgacgaggccgacuacuacugcgccaccugggacagcagccugagcggcggcggcguguucggcaccggcaccagagugaccgugcug

SEQ ID NO: 33350 - RNA, 333 nt, Artificial Sequence
  derived and/or modified sequence opt4 from anti-HIV_038-197677_VR-Chain
cagagcgugcugacccagccccccagcgugagcgccgcccccggccagaaggugaccgugagcugcagcggcagcaacagcaacaucggcaaccacuacgugagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33351 - RNA, 333 nt, Artificial Sequence
  derived and/or modified sequence opt4 from anti-HIV_038-196765_VR-Chain
cagagcgcccugacccagcccgccagcgugagcggcagccccggccagagcaucaccaucagcugcaccggcaccagcggcgacgugggcuacaaccuggugagcugguaccagcagcugcccggcaccgcccccaaggugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33352 - RNA, 333 nt, Artificial Sequence
  derived and/or modified sequence opt4 from anti-HIV_038-186200_VR-Chain
cagagcgugcugacccagccccccagcgccagcggcacccccggccagagaaucaccaucagcugcagcggcaccagcagcaacaucggcagcaacaucgugagcugguaccagcaccugcccggcaccacccccaagcuggugaucuucagaaacaaccagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33353 - RNA, 333 nt, Artificial Sequence
  derived and/or modified sequence opt4 from anti-HIV_038-126170_VR-Chain
cagagcgugcugacccagccccccagcgugagcgccccccccggccagaaggugaccaucagcugcagcggcaccaccagcaacaucggcagcaacuacguggccugguaccagcagcugcccggcaccgcccccaagcugcugaucuacgacaacgugaagagacccaccaacauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33354 - RNA, 333 nt, Artificial Sequence
  derived and/or modified sequence opt4 from anti-HIV_038-108545_VR-Chain
cagagcgugcugacccagccccccagcgccagcggcacccccggccagagagugaccaucagcugcagcggcagcagcagcaacaucggcuacaacaccgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33355 - RNA, 333 nt, Artificial Sequence
  derived and/or modified sequence opt4 from anti-HIV_038-107263_VR-Chain
cagagcgugcugacccagccccccagcgccagcggcacccccggccagagagugaccaucagcugcagcggcagcagcagcaacaucggcagcaacaccgugaacugguaccagcaggugcccggcaccgcccccaaccugcugaucuacagcaacgaccagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33356 - RNA, 333 nt, Artificial Sequence
  derived and/or modified sequence opt4 from anti-HIV_038-104530_VR-Chain
cagagcgugcugacccagccccccagcgugagcgccgcccccggccagaaggugaccaucagcugcagcggcagcagcagcaacaucggcagcaacuacgugagcugguaccagcaccugcccggcaaggcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33357 - RNA, 333 nt, Artificial Sequence
  derived and/or modified sequence opt4 from anti-HIV_038-099169_VR-Chain
cagagcgugcugacccagccccccagcgccagcggcacccccggccagagagugagcaucagcugcagcggcaucaccagcagccugggcagcaaccacaugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33358 - RNA, 333 nt, Artificial Sequence
  derived and/or modified sequence opt4 from anti-HIV_038-075067_VR-Chain
cagagcgugcugacccagccccccagcgugagcggcgcccccggccagagagugaccaucagcugcagcggcagcagcagcaccaucggcaacaacuacgugagcugguaccagcugcugcccggcaccgcccccaagcugcugaucuacaagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33359 - RNA, 333 nt, Artificial Sequence
  derived and/or modified sequence opt4 from anti-HIV_038-072368_VR-Chain
cagagcgugcugacccagagccccagcgccagcggcacccccggccagagagugaccaucagcugcagcggcagcagcagcaacaucggcaacaacuacgugagcugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33360 - RNA, 333 nt, Artificial Sequence
  derived and/or modified sequence opt4 from anti-HIV_038-068503_VR-Chain
cagagcgugcugacccagccccccagcgugagcgccgcccccggccagauggugaccaucagcugcagcggcagcagaagcaacaucgagaaccacuacgugagcugguaccagcaccugcccggcgccgcccccaagcugcugaucuacgacaacggcaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33361 - RNA, 333 nt, Artificial Sequence
  derived and/or modified sequence opt4 from anti-HIV_038-068016_VR-Chain
cagagcgugcugacccagccccccagcgccagcggcacccccggccagagagugaccaucagcugcagcggcagcagcagcaacaucgagagcaacuucguguacugguaccagcaguuccccggcaccacccccaagcugcugaucuacagagacggccagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33362 - RNA, 333 nt, Artificial Sequence
  derived and/or modified sequence opt4 from anti-HIV_038-063958_VR-Chain
cagagcgugcugacccagccccccagcgugagcggcgcccccggccagagagugaccaucagcugcaccggcagcagcagcaacaucggcaacagcggcgugcacugguaccagcagcugcccggcaccgcccccaagcugcugaucuacgagaacaacaagagacccagcggcauccccgacagauucagcggcagcaagagcggcaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33363 - RNA, 333 nt, Artificial Sequence
  derived and/or modified sequence opt4 from anti-HIV_038-033733_VR-Chain
cagagcgugcugacccagccccccagcgccagcggcacccccggccagagagugaccaucagcugcagcggcagcagcagcaacaucggcagcaaguacguguacugguaccagcagcugcccggcaccgcccccaagcugcugaucuacgacaacgacaagagacccagcggcauccccgacagaaucagcgccagcaagagcggcaccagcgccacccuggacaucaccagacugcagaccggcgacgaggccgacuacuacugcggcaccugggacagcagccugagcgccggcggcguguucggcaccggcaccaaggugaccgugcug

SEQ ID NO: 33364 - RNA, 333 nt, Artificial Sequence
  derived and/or modified sequence opt4 from anti-HIV_038-030557_VR-Chain
cagagcgugcugacccagccccccagcgugagcgccgcccccggccagaaggugaccaucagcugcagcggcagcagcagcaccaucggcaacaacuacgugagcugguaccagcugcugcccggcaccgcccccaagcugcugaucuacaagaacaacaagagacccagcggcauccccgacagauucagcggcagcaagagcggcaccagcgccacccugggcaucaccggccugcagaccggcgacggcgccgacuacuacugcggcaccugggacaccagccugagcgccggcggcguguucggcaccggcaccaucgugaccgugcug

SEQ ID NO: 33365 - RNA, 333 nt, Artificial Sequence
  derived and/or modified sequence opt4 from anti-HIV_038-024298_VR-Chain
cagagcgugcugacccagccccccagcgugagcgccgcccccggccagaaggugaccaucagcugcagcggcagcagcagcaacaucggcaacagccacgugagcugguaccagcaguuccccggcaccggccccaagcugcugaucuacgagaacgccaagagacccagcggcauccccgacagaaucagcggcagcaagagcgacaccagcgccacccugggcaucaccggccugcagaccggcgacgaggccgacuacuacugcggcaccugggacagcagccugagcgccggcggcguguucggcaccggcaccaaggugaccgugcug

SEQ ID NO: 33366 - RNA, 333 nt, Artificial Sequence
  derived and/or modified sequence opt4 from anti-HIV_038-011154_VR-Chain
cagagcgugcugacccagccccccagcgugagcgccgcccccggccagagaaucaccaucagcugcagcggcagcagcagcaacaucggcaacaacuacgugagcugguaccagcagcugcccggcaccgcccccaagcugcugaucuacaagaacaacaagagacccagcggcauccccgacagauucagcggcagcaagagcggcaccagcgccacccugggcaucaccggccugcagaccggcgacgaggccgacuacuacugcggcaccugggacaccagccugagcgccggcggcguguucggcaccggcaccaaggugaccgugcug

SEQ ID NO: 33367 - RNA, 318 nt, Artificial Sequence
  derived and/or modified sequence opt4 from anti-HIV-1_LightChain
gagaucgugcugacccagagccccggcacccugagccugagccccggcgagagagccacccugagcugcagagccagccagagcgugagcaacaacuuccuggccugguaccaguacaagcccggccagccccccagagugcugaucuacggcaccagcagaagagccagcggcauccccgacagauucagcggcagcggcagcggcaccgacggcagccugaccaucagcagacuggaggccgaggacuucgccguguacuacugccagcaguacgaguucuucggccagggcaccagacuggagaugaagagaacc

SEQ ID NO: 33368 - RNA, 318 nt, Artificial Sequence
  derived and/or modified sequence opt4 from anti-HIV-1_LightChain
gagguggugcugacccagagccccggcacccugagccugagccccggcgagagagccacccugagcugcagagccagccagagcgugagcagaaacuaccuggccugguaccagcagaagcugggccacggccccagacugcugguguacgccaccagcagaagagccaccggcauccccgacagauucaucggcagccagagcggcaccgaguacaaccugaccaucaccagacuggaccccggcgacuucgcccaguacuucugccagcaguacgaguucuucggccccggcaccagacuggacaucaagagaacc

SEQ ID NO: 33369 - RNA, 309 nt, Artificial Sequence
  derived and/or modified sequence opt4 from anti-HIV-1_LightChain
gagguggugcugacccagagccccggcacccugagccugagccccggcgagagagccagcuucagcugcaagagcagccaguacggccacaccgccugguaccagcagaagcugggccacggccccagacugcugaucuacgccaccagcagaagagccaccggcauccccgacagauucaucggcagccagagcggcaccgaguacaaccugaccaucaccagacuggaccccggcgacuucgcccacuacuucugccagcagaacgaguucuucggccccggcaccagacuggacaugaagagaacc

SEQ ID NO: 33370 - RNA, 306 nt, Artificial Sequence
  derived and/or modified sequence opt4 from anti-HIV-1_LightChain
gagaucgugcugacccagagccccagcagccugagccugagccccggcgagagagccagccugagcugcagaggcagccacggccacguggccugguaccagcacaagcccggccagauccccagacugcugaucuacgccaccagcaagagagccagcggcaucagcgacagauucagcggcagcggcagcggcaccgacgccacccugagcaucagcagacuggagcccgaggacuucgccguguacuucugccagcaguacgaguucuucggccagggcaccagacuggagaucaagagaacc

SEQ ID NO: 33371 - RNA, 306 nt, Artificial Sequence
  derived and/or modified sequence opt4 from anti-HIV-1_LightChain
gagaucaugcugacccagagccccggcacccugagccugagccccggcgagagagccacccugagcugcagaggcagccacggccacguggccugguaccagcagaagcccggcagaauccccagacugcugaucuacggcaccagcaagagagccagcggcauccccgacagauucagcggcagcggcagcggcaccgacgccacccugaccaucagcagacuggagagcgaggacuucgccguguacuucugccagcaguacgaguucuucggccagggcaccagacuggacaucaacagaacc

SEQ ID NO: 33372 - RNA, 309 nt, Artificial Sequence
  derived and/or modified sequence opt4 from anti-HIV-1_LightChain
gagagcgugcugacccagagccccggcacccugagccugagccccggcgagaccgccagccugagcugcaccgccgcccuguacggccacaugaccugguaccagaagaagcccggccagccccccaagcugcugcuguacgccagcagcaagagagccagcggcauccccgacagauucagcggcagccaguucggcaagcaguacacccugaucaucaccaagauggagcccgaggacuucgccgaguacuacugccagcaguucgagguguucggccagggcaccagacuggacaugagaagaacc

SEQ ID NO: 33373 - RNA, 306 nt, Artificial Sequence
  derived and/or modified sequence opt4 from anti-HIV-1_LightChain
gagguggugcugacccagagccccggcacccugagccugagccccggcgagagagccacccugagcugcagaggcagccacggccaccugagcugguaccaguacaagcccggccagccccccagagugcugaucuacggcaccagcagaagagccagcggcauccccgacagauucagcggcagcggcagcggcaccgacggcagccugaccaucagcagacuggaggccgaggacuucgccguguacuacugccagcaguacgaguucuucggccagggcaccagacuggagaugaagagaacc

SEQ ID NO: 33374 - RNA, 309 nt, Artificial Sequence
  derived and/or modified sequence opt4 from anti-HIV-1_LightChain
gagguggugcugacccagagccccggcacccugagccugagccccggcgagagagccagccugagcugcaagagcagccaguacggccacaccgccugguaccagcagaagcugggccagggccccagacugcugaucuacgccaccagcagaagagccaccggcauccccgacagauucagcggcagccagagcggcaccgaguacaaccugaccaucaccagacuggaccccggcgacuucgcccaguacuucugccagcaguacgaguucuucggccccggcaccagacuggacaucaagagaacc

SEQ ID NO: 33375 - RNA, 306 nt, Artificial Sequence
  derived and/or modified sequence opt4 from anti-HIV-1_LightChain
gagaucaugcugacccagagccccggcacccugagccugagccccggcgagagagccacccugagcugcagaggcagccacggccacguggccugguaccagcagaagcccggcagaauccccagacugcugaucuacggcaccagcaagagagccagcggcauccccgacagauucagcggcagcggcagcggcaccgacgccacccugaccaucagcagacuggagagcgaggacuucgccguguacuacugccagcaguacgaguucuucggccagggcaccagacuggacaucaagagaacc

SEQ ID NO: 33376 - RNA, 309 nt, Artificial Sequence
  derived and/or modified sequence opt4 from anti-HIV-1_LightChain
gagagcgugcugacccagagccccggcacccugagccugagccccggcgagaccgccagccugagcugcaccgccgccagcuacggccacaugaccugguaccagaagaagcccggccagccccccaagcugcugaucuucgccaccagcaagagagccagcggcauccccgacagauucagcggcagccaguucggcaagcaguacacccugaccaucaccagaauggagcccgaggacuucgccggcuacuacugccagcagguggaguucuucggccagggcaccagacuggagaucagaagaacc

SEQ ID NO: 33377 - RNA, 309 nt, Artificial Sequence
  derived and/or modified sequence opt4 from anti-HIV-1_LightChain
gacauccagaugacccagagccccagcagccugagcgccagcgugggcgacagagugaccaucaccugccaggccagccaggacaucagcaacuaccugaacugguaccagcagaagcccggcaaggcccccaagcugcugaucuacgacgccagcaaccuggagaccggcgugcccagcagauucagcggcagcggcuuccacaccaccuucagccugaccaucagcggccugcagagagacgacuucgccaccuacuucugcgccgugcuggaguucuucggccccggcaccaagguggacuucaac

SEQ ID NO: 33378 - RNA, 309 nt, Artificial Sequence
  derived and/or modified sequence opt4 from anti-HIV-1_LightChain
gacauccagaugacccagagccccagcagccugagcgccagcgugggcgacagagugaccaucaccugccaggccagccaggacaucaccaacuaccugaacugguaccagcagaagcccggcagagcccccaagcugcuggugcacggcgccagcaaccugcagagaggcgugcccagcagauucagcggcagcggcuuccacaccaccuucacccugaccaucagcagccugcagcccgacgacguggccaccuacuucugcgagguguuccagugguucggccccggcaccagaguggacuucaac

SEQ ID NO: 33379 - RNA, 309 nt, Artificial Sequence
  derived and/or modified sequence opt4 from anti-HIV-1_LightChain
ggcuuccagcugacccagagccccagcagccugagcgccagcgugggcgacagagugagcaucaacugccaggccggcgagggcaucggcagcagccugaacugguaccagcagaagcccggcagagcccccaagcugcuggugcacggcgccagcaaccugcagagaggcgugcccagcagauucagcggcagcggcuuccacaccaccuucacccugaccaucagcagccugcagcccgacgacguggccaccuacuucugcgagguguuccagugguucggccccggcaccagaguggacuucaac

SEQ ID NO: 33380 - RNA, 309 nt, Artificial Sequence
  derived and/or modified sequence opt4 from anti-HIV-1_LightChain
ggcauccagcugacccagagccccagcagccugagcgugagcgugggcgacagagugaccaucaccugcagagccagccagggcaucggcaacagccugaacugguaccagcagaagcccggcaaggcccccaaccugaugguguucggcaccaccaagcugaacagaggcgugcccagcagauucagcggcagcggcagcggcaccaccgccacccugaccaucaacagccugcagcccgaggacaucgccaccuacuucugccagguguucgaguuccugggccccggcaccaagcuggacaugaag

SEQ ID NO: 33381 - RNA, 309 nt, Artificial Sequence
  derived and/or modified sequence opt4 from anti-HIV-1_LightChain
gacauccagaugacccagagccccagcagccugagcgccagcgugggcgacagagugaccaucaccugccaggccggccagggcaucggcagcagccugaagugguaccagcagaagcccggcagagcccccagacugcuggugcacggcgccagcaaccugcacagaggcgugcccagcagauucagcggcagcggcuuccacaccaccuucagccugaccaucagcggccugcagagagacgacuucgccaccuacuucugcgccgugcuggaguucuucggccccggcaccaagguggacuucaac

SEQ ID NO: 33382 - RNA, 309 nt, Artificial Sequence
  derived and/or modified sequence opt4 from anti-HIV-1_LightChain
ggcauccagcugacccagagccccagcagccugagcgccagcgugggcgacagagugaccaucaccugccaggccagccagggcaucggcagcagccugcagugguaccagcagaagcccggcagagcccccaaccugcuggugcacggcgccagcaaccugcacagaggcgugcccagcagauucagcggcagcggcuuccacaccaccuucagccugaccaucagcggccugcagagagacgacuucgccaccuacuucugcgccgugcuggaguucuucggccccggcaccaagguggagaucaag

SEQ ID NO: 33383 - RNA, 309 nt, Artificial Sequence
  derived and/or modified sequence opt4 from anti-HIV-1_LightChain
ggcgugcagcugacccagagccccagcagccugagcgccagcgugggcgacagagugagcaucaacugccaggccggccagggcaucggcagcagccugaacugguaccagcagaagagaggcaaggcccccaagcugcuggugcacggcgccagcacccugcagagaggcgugcccagcagauucagcggcagcggcuuccacaccaccuucacccugaccaucagcagccugcagcccgacgacguggccaccuacuucugcgagguguuccagugguucggccccggcaccagaguggacuucaac

SEQ ID NO: 33384 - RNA, 306 nt, Artificial Sequence
  derived and/or modified sequence opt4 from anti-HIV-1_LightChain
uacauccagcugacccagagccccagcagccugagcgccagcaucggcgacagagugaccaucgccugcagagccagccagggcaucggcuacgugcacugguaccagcagaagagaggcaagccccccaagcugcugauccacggcgccagcauccuggagagaggcgugcccagcagauucagcggcagcggcagcggcacccuguucaaccugaccgugagcggccugcagcccgaggacuucgccaccuacaugugccagguguucgagagcuucggccccggcaccaaggugcagaugaag

SEQ ID NO: 33385 - RNA, 309 nt, Artificial Sequence
  derived and/or modified sequence opt4 from anti-HIV-1_LightChain
ggcauccagcugacccagagccccagcagccugagcgccagccugggcgacagagugaccaucaccugccaggccagccagggcaucggcagcagccugcagugguaccagcagaagcccggcaaggcccccaagcugcuggugcacggcgccagcaagcugcacagaggcgugcccagcagauucagcggcagcggcuuccacaccaccuucagccugaccaucagcagccugcagcccgaggacuucgccaccuaccugugccaggugcuggaguucuucggccccggcaccaagguggacuucaac

SEQ ID NO: 33386 - RNA, 309 nt, Artificial Sequence
  derived and/or modified sequence opt4 from anti-HIV-1_LightChain
ggcauccagcugacccagagccccagcagccugagcgccagcgugggcgacaccgugaccaucaccugccaggccagccagggcaucggcagcagccugcagugguaccagcagaagagaggcagagcccccaagcugcuggugcacggcgccagcaaccugcagggcggcgugcccagcagauucagcggcagcggcuuccacaccaccuucacccuggccaucagaggccugcagcccgacgacuucgccaccuacuucugccagagccuggaguucuucggccccggcaccaagguggacaugaag

SEQ ID NO: 33387 - RNA, 306 nt, Artificial Sequence
  derived and/or modified sequence opt4 from anti-HIV-1_LightChain
uacauccagcugacccagagccccagcagccugagcgccagcgugggcgacagagugaccaucaccugcagagccagccaggacaucggcuacgugagcugguacgcccagaagagaggcagagcccccaagcugcugauccacggcgccagcggccuggagagaggcgugcccagcagauucagcggcagcggcagcggcacccuguucacccugaccaucgagagccugcagcccgaggacuucgccaccuacaugugccagguguucgagagcuucggccccggcaccaagguggagaugaag

SEQ ID NO: 33388 - RNA, 309 nt, Artificial Sequence
  derived and/or modified sequence opt4 from anti-HIV-1_LightChain
ggcauccagcugacccagagccccagcagccugagcgccagcgugggcgacagagugagcaucaacugccaggccggccagggcaucggcagcagccugaacugguaccagcagaagcccggcagagcccccaagcugcuggugcacggcgccagcaaccugcagagaggcgugcccagcagauucagcggcagcggcuuccacaccaccuucacccugaccaucagcagccugcagcccgacgacguggccaccuacuucugcgccguguuccagugguucggccccggcaccagaguggacuucaac

SEQ ID NO: 33389 - RNA, 366 nt, Artificial Sequence
  derived and/or modified sequence opt4 from anti-HIV-1_HeavyChain
agccagcagcuggugcagagcggcacccaggugaagaagcccggcgccagcgugagaaucagcugccaggccagcggcuacaccuucaccgacuacgugcugcacugguggagacaggcccccggccagggccuggaguggaugggcuggaucaagcccguguacggcgccagaaacuacgccagaagauuccagggcagaaucgacuucagcagagacaucuacagagagaucgccuacauggaccugagcggccugagaagcgacgacaccgcccuguacuucugcgccagagacggcagcggcgacgacaccagcuggcaccuggaccccuggggccagggcacccuggugaucgugagcgcc

SEQ ID NO: 33390 - RNA, 366 nt, Artificial Sequence
  derived and/or modified sequence opt4 from anti-HIV-1_HeavyChain
agccagcagcuggugcagagcggcacccaggugaagaagcccggcgccagcgugagaaucagcugccaggccagcggcuacaccuucaccgacuaccugcugcacugguggagacaggcccccggccagagacuggaguggaugggcuggaucaagcccguguacggcgccagaaacuacgcccacagauuccagggcagaaucaacuucgacagagacaucuacagagagaucgccuucauggaccugagcggccugagaagcgacgacaccgccguguacuucugcgccagagacggcggcggcgacgacagaaccuggcugcuggacaccuggggccagggcacccuggugguggugagcagc

SEQ ID NO: 33391 - RNA, 366 nt, Artificial Sequence
  derived and/or modified sequence opt4 from anti-HIV-1_HeavyChain
caggugcaccuggagcagcccggcagcguggugagauggcccggcgccagccugacccugagcugcaccgccagcggcuacaucuucgugaacuaccacauccacuggcugagacaggcccccggccagagacuggagcugcugggcaccaucaaccccgugggcggcgccaccagcuacgcccagaaguucagaggcagacuggugcugaccagagacaucggcagcagcaccgugacccugcugcugaaccaccugagaagagacgacagcgccguguacuucugcgccagagagagcaacgccagcggcagaggcagaagcauggaccacuggggcagaggcagcagagugaucgugagccag

SEQ ID NO: 33392 - RNA, 366 nt, Artificial Sequence
  derived and/or modified sequence opt4 from anti-HIV-1_HeavyChain
caggugcagcuggugcagagcggcgccgaggugaagaagcccggcgccagcgugagagugagcugccaggccagcggcuacaccuucaccaacuacauccugcacugguggagacaggcccccggccagggccuggaguggaugggccugaucaagcccguguacggcgccgugaacuacgccagacaguuccagggcagaauccagcugaccagagacaucuacagagagaucgccuuccuggaccugagcggccugagaagcgacgacaccgccguguacuacugcgccagagacgagagcggcgacgaccugaaguggcaccugcaccccuggggccagggcacccaggugaucgugagcccc

SEQ ID NO: 33393 - RNA, 366 nt, Artificial Sequence
  derived and/or modified sequence opt4 from anti-HIV-1_HeavyChain
caggugcagcuggugcagagcggcgccgaggugaagaagcccggcgccagcgugagaaucagcugccaggccagcggcuacaccuucaccgacuacgugcugcacugguggagacaggcccccggccagggccuggaguggaugggcuggaucaagcccguguacggcgccagaaacuacgccagaagauuccagggcagaaucaacuucgacagagacaucuacagagagaucgccuacauggaccugagcggccugagaagcgacgacaccgccagauacuucugcgccagagacggcagcggcgacgacaccagcuggcaccugcaccccuggggccagggcacccuggugaucgugagcgcc

SEQ ID NO: 33394 - RNA, 366 nt, Artificial Sequence
  derived and/or modified sequence opt4 from anti-HIV-1_HeavyChain
agccagcagcuggugcagagcggcacccaggugaagaagcccggcgccagcgugagagugagcugccaggccagcggcuacaccuucaccaacuacauccugcacugguggagacaggcccccggccagggccuggaguggaugggccugaucaagcccguguacggcgccgugaacuacgccagacaguuccagggcagaauccagcugaccagagacaucuacagagagaucgccuuccuggaccugagcggccugagaaccgacgacaccgccguguacuacugcgccagagacgagagcggcgacgaccugaaguggcaccugcaccccuggggccagggcacccaggugaucgugagcccc

SEQ ID NO: 33395 - RNA, 366 nt, Artificial Sequence
  derived and/or modified sequence opt4 from anti-HIV-1_HeavyChain
caggugcaccuggagcagagcggcagcguggugagauggcccggcgccagccugacccugagcugcaccgccagcggcuacaucuucgugaacuaccacauccacuggcugagacaggcccccggccagagacuggagcugaugggcaccaucaaccccgugggcggcgccaccagcuacacccagagauucagaggcagacuggugcugaccagagacaucggcagcaacaccgugacccugcugcugaaccaccugagaagcgacgacagcgccguguacuucugcgccagagagagcaacgccagcggcagaggcagaagcauggaccacuggggcagaggcagccacgugaucgugagcccc

SEQ ID NO: 33396 - RNA, 366 nt, Artificial Sequence
  derived and/or modified sequence opt4 from anti-HIV-1_HeavyChain
agccagcaccuggugcagagcggcacccaggugaagaagcccggcgccagcgugagagugagcugccaggccagcggcuacaccuucaccaacuacauccugcacugguggagacaggcccccggccagggccuggaguggaugggccugaucaagcccguguacggcgccgugaacuacgccagacaguuccagggcagaauccagcugaccagagacaucuacagagacaucgccuuccuggaccugagcggccugagaagcgacgacaccgccguguacuacugcgccagagacgagagcggcgacgaccugaaguggcaccugcaccccuggggccagggcacccaggugaucgugagcccc

SEQ ID NO: 33397 - RNA, 366 nt, Artificial Sequence
  derived and/or modified sequence opt4 from anti-HIV-1_HeavyChain
agccagcagcuggugcagagcggcacccaggugaagaagcccggcgccagcgugagaaucagcugccaggccagcggcuacaccuucaccgacuacgugcugcacugguggagacaggcccccggccagggccuggaguggaugggcuggaucaagcccguguacggcgccagaaacuacgccagaagauuccagggcagaaucaacuucgacagagacaucuacagagagaucgccuacauggaccugagcggccugagaagcgacgacaccgccagauacuucugcgccagagacggcagcggcgacgacaccagcuggcaccugcaccccuggggccagggcacccuggugaucgugagcgcc

SEQ ID NO: 33398 - RNA, 366 nt, Artificial Sequence
  derived and/or modified sequence opt4 from anti-HIV-1_HeavyChain
caggugcaccuggagcagcccggcagcguggugagauggcccggcgccagccugacccugagcugcaccgccagcggcuacaucuucgugaacuaccacauccacuggcugagacaggcccccggccagagacuggagcugcugggcaccaucaaccccgugggcggcgccaccagcuacgcccagaaguucagaggcagacuggugcugaccagagacaucggcagcagcaccgugacccugcugcugaaccaccugagaagagacgacagcgccguguacuucugcgccagagagagcaacgccagcggcagaggcagaagcauggaccacuggggcagaggcaagcccgugaucgugagcccc

SEQ ID NO: 33399 - RNA, 321 nt, Artificial Sequence
  derived and/or modified sequence opt4 from anti-HIV-1_HeavyChain
gagaucgugaugacccagagccccgccauccugagcgugagccccggcgacagagccaccuucagcugcagagccagccagagcgugaagaacaaccuggccugguaccagaagagacccggccaggcccccagacugcugaucuucgacgccagcagcagagccagcggcauccccgccagauucagcggcggcggcagcggcaccgaguucacccugaccgugaacagcaugcagagcgaggacuucgccaccuacuacugccagcaguacgaggaguggcccagaaccuucggccagggcaccaagguggagaucaug

SEQ ID NO: 33400 - RNA, 321 nt, Artificial Sequence
  derived and/or modified sequence opt4 from anti-HIV-1_HeavyChain
cagaucgugcugacccagagcccccccacccugagccugagccccggcgagagagccacccugagcugcagagccagccagagcgugaagaacaaccuggccugguaccagaagagacccggccaggcccccagacugcugaucuucgacaccagcagcagagccagcaacauccccgccagauucagcggcggcggcagcggcaccgaguucacccugaccgugaacagcaugcagagcgaggacuucgccaccuacuacugccagcaguacgaggaguggcccagaaccuucggccagggcaccaagguggagaucauc

SEQ ID NO: 33401 - RNA, 321 nt, Artificial Sequence
  derived and/or modified sequence opt4 from anti-HIV-1_HeavyChain
gagaucgugaugacccagagccccgccgugcugagcgugagccccggcgacagagccacccugagcugcagagccagccagagcgugaagaacaaccuggccugguaccagaagagacccggccaggcccccagacugcugaucuucgacaccagcagcagagccagcaacauccccgccagauucagcggcggcggcagcggcaccgaguucacccugaccgugaacagcaugcagagcgaggacuucgccaccuacuacugccagcaguacgaggaguggcccagaaccuucggccagggcaccaagguggagaucaac

SEQ ID NO: 33402 - RNA, 321 nt, Artificial Sequence
  derived and/or modified sequence opt4 from anti-HIV-1_HeavyChain
gagaucgugcugacccagagcccccccacccugagcgugagccccggcgaggccgccacccugagcugcagagccagccagagcgugaagaacaaccuggccugguaccaccugaaggccggccaggcccccagacugcugaucuucgacgccagcagcagagccggcgacgcccccgccagagugagcggcagcggcuacggcaccgaguucacccugaccgugaacagcgugcagagcgaggacuucggcgacuacuacugccagcaguacgaggaguggcccagaaccuucggccagggcaccaagguggaccugaga

SEQ ID NO: 33403 - RNA, 321 nt, Artificial Sequence
  derived and/or modified sequence opt4 from anti-HIV-1_HeavyChain
gagaucgugaugacccagagcccccccacccugagcgugagccccggcgagaccgccacccugagcugcagagccagccagaacgugaagaacaaccuggccugguaccagcugaagcccggccaggcccccagacugcugaucuucgacgccagcagcagagccggcggcauccccgacagauucagcggcagcggcuacggcaccgacuucacccugaccgugaacagcgugcagagcgaggacuucggcgacuacuucugccagcaguacgaggaguggcccagaaccuucggccagggcaccaagguggaccugaga

SEQ ID NO: 33404 - RNA, 321 nt, Artificial Sequence
  derived and/or modified sequence opt4 from anti-HIV-1_HeavyChain
gagaucgugaugacccagagccccgccgugcugagcgugagccccggcgacagagccacccugagcugcagagccagccagagcgugaagaacaaccuggccugguaccagaagagacccggccaggcccccagacugcugaucuucgacaccagcagcagagccagcaacauccccgccagauucagcggcggcggcagcggcaccgaguucacccugaccgugaacagcaugcagagcgaggacuucgccaccuacuacugccagcaguacgaggaguggcccagaaccuucggccagggcaccaagguggagaucauc

SEQ ID NO: 33405 - RNA, 399 nt, Artificial Sequence
  derived and/or modified sequence opt4 from anti-HIV-1_HeavyChain
gaggugcaccugcaggagagcggccccggccuggugagaccccuggagacccugagccugaccugcaccgccagcggcgccagcaucagaggcggcgaguggggcgacaacgacuaccacuggggcugggugagacacagccccgagaagggccuggaguggaucggcagcauccacuggagaggcaccacccacuacaacgcccccuucagaggcagagccacccugagcaucgacaccagcagaaaccaguucuuccugagacugaccagcaugaccgccgacgacaccgccguguacuacugcgugaagcacaaguaccacgacaucgugaugguggugcccaucgccggcugguucgaccccuggggccagggccugcaggugaccgugagcgcc

SEQ ID NO: 33406 - RNA, 399 nt, Artificial Sequence
  derived and/or modified sequence opt4 from anti-HIV-1_HeavyChain
gaggugcaccugcaggagagcggccccggccuggugagaccccuggagacccugagccugaccugcaccgccagcggcgccagcaucagaggcggcgaguggggcgacaacgacuaccacuggggcugggugagacacagccccgagaagggccuggaguggaucggcagcauccacuggagaggcaccacccacuacaacgcccccuucagaggcagagccacccugagcaucgacaccagcagaaaccaguucuuccugagacugaccagcaugaccgccgacgacaccgccguguacuacugcgugaagcacaaguaccacgacaucgugaugguggugcccaucgccggcugguucaaccccuggggccagggccugcaggccaccgugcccagc

SEQ ID NO: 33407 - RNA, 399 nt, Artificial Sequence
  derived and/or modified sequence opt4 from anti-HIV-1_HeavyChain
caggugcagcugaaggagagcggccccggccuggugaagcccagcgagacccugagccugaccugcaccgugagcggcggcagcaugagaggcaccgacuggggcgagaacgacuuccacuacggcuggaucagacacagcagcgccgagggccuggaguggaucggcagcauccacuggagaggcaccacccacuacaagaugagcuucagaagcagagccaccaucagcaucgacaccagcaacaacagauucagccugauguucagcuucgugaccgccgaggacaccgccguguacuacugcgccagacacaaguaccacgacaucuucagaguggugcccguggccggcugguucgaccccuggggccagggccugcuggugaccgugagcagc

SEQ ID NO: 33408 - RNA, 399 nt, Artificial Sequence
  derived and/or modified sequence opt4 from anti-HIV-1_HeavyChain
gaggugcaccugcaggagagcggccccggccuggugagaccccuggagacccugagccugaccugcaccgccagcggcgccagcaucagaggcggcgaguggggcgacaacgacuaccacuggggcugggugagacacagccccgagaagggccuggaguggaucggcagcauccacuggagaggcaccacccacuacaacgcccccuucagaggcagagccacccugagcaucgacaccagcaagaaccaguucagccugagacugaccagcaugaccgccgacgacaccgccguguacuacugcgugaagcacaaguaccacgacaucgugaugguggugcccuucgccggcugguucgaccccuggggccagggccugagagugaccgugagcgcc

SEQ ID NO: 33409 - RNA, 399 nt, Artificial Sequence
  derived and/or modified sequence opt4 from anti-HIV-1_HeavyChain
gaggugcaccugcaggagagcggccccggccuggugagaccccuggagacccugagccugaccugcaccgccagcggcgccagcaucagaggcggcgaguggggcgacaacgacuaccacuggggcugggugagacacagccccgagaagggccuggaguggaucggcagcauccacuggagaggcaccacccacuacaacgcccccuucagaggcagagccacccugagcaucgacaccagcaagaaccaguucuuccugagacugaccagcaugaccgccgacgacaccgccguguacuacugcgugaagcacaaguaccacgacaucugcaugguggugcccaucgccggcugguucgaccccuggggccagggccugcaggugaccgugagccag

SEQ ID NO: 33410 - RNA, 399 nt, Artificial Sequence
  derived and/or modified sequence opt4 from anti-HIV-1_HeavyChain
caggugcaccugcaggagagcggccccggccuggugagaccccuggagacccugagccugaccugcaccgccagcggcgccagcaucagaggcggcgaguggggcgacaacgacuaccacuggggcugggugagacacagccccgagaagggccuggaguggaucggcagcauccacuggagaggcaccacccacuacaacgcccccuucagaggcagagccacccugagcaucgacaccagcagaaaccaguucuuccugagacugaccagcaugaccgccgacgacaccgccguguacuacugcgugaagcacaaguaccacgacaucgugaugguggugcccaucgccggcugguucgaccccuggggccagggccugcaggugaccgugagcagc

SEQ ID NO: 33411 - RNA, 399 nt, Artificial Sequence
  derived and/or modified sequence opt4 from anti-HIV-1_HeavyChain
caggugcaccugcaggagagcggccccggccuggugagaccccuggagacccugagccugaccugcaccgccagcggcgccagcaucagaggcggcgaguggggcgacaacgacuaccacuggggcugggugagacacagccccgagaagggccuggaguggaucggcagcauccacuggagaggcaccacccacuacaacgcccccuucagaggcagagccacccugagcaucgacaccagcagaaaccaguucuuccugagacugaccagcaugaccgccgacgacaccgccguguacuacugcgugaagcacaaguaccacgacaucgugaugguggugcccaucgccggcugguucgaccccuggggccagggccugagagugaccgugagccag

SEQ ID NO: 33412 - RNA, 399 nt, Artificial Sequence
  derived and/or modified sequence opt4 from anti-HIV-1_HeavyChain
caggugcaccugcaggagagcggccccggccuggugagaccccuggagacccugagccugaccugcaccgccagcggcgccagcaucagaggcggcgaguggggcgacaacgacuaccacuggggcugggugagacacagccccggcaagggccuggaguggaucggcagcauccacuggagaggcaccacccacuacaacgcccccuucagaggcagagccacccugagcaucgacaccuucagaaaccaguucuuccugagacugaccagcaugaccgccgacgacaccgccguguacuacugcgugaagcacaaguaccacgacaucgugaugguggugcccaucgccggcugguucgaccccuggggccagggccugcaggugaccgugagccag

SEQ ID NO: 33413 - RNA, 399 nt, Artificial Sequence
  derived and/or modified sequence opt4 from anti-HIV-1_HeavyChain
gaggugcaccugcaggagagcggccccggccuggugagaccccuggagacccugagccugaccugcaccgccagcggcgccagcaucagaggcggcgaguggggcgacaacgacuaccacuggggcugggugagacacagccccgagaagggccuggaguggaucggcagcauccacuggagaggcaccacccacuacaacgcccccuucagaggcagagccacccugagcaucgacaccagcagaaaccaguucuuccugagacugaccagcaugaccgccgacgacaccgccguguacuacugcgugaagcacaaguaccacgacaucgugaugguggugcccaucgccggcugguucgaccccuggggccagggccugagaggcaccgugagcgcc

SEQ ID NO: 33414 - RNA, 393 nt, Artificial Sequence
  derived and/or modified sequence opt4 from anti-HIV-1_HeavyChain
caggugcagcuggugcagagcggcgccgugaucaagacccccggcagcagcgugaagaucagcugcagagccagcggcuacaacuucagagacuacagcauccacugggugagacugauccccgacaagggcuucgaguggaucggcuggaucaagccccuguggggcgccgugagcuacgccagacagcugcagggcagagugagcaugaccagacagcugagcagagaccccgacgaccccgacuggggcguggccuacauggaguucagcggccugacccccgccgacaccgccgaguacuucugcgugagaagaggcagcugcgacuacugcggcgacuuccccuggcaguacuggggccagggcaccguggugguggugagcagcgcc

SEQ ID NO: 33415 - RNA, 393 nt, Artificial Sequence
  derived and/or modified sequence opt4 from anti-HIV-1_HeavyChain
caggugcagcuggugcagagcggcgccgugaucaagacccccggcagcagcgugaagcugagcugcagagccagcggcuacaacuucagagacuacagcauccacugggugagacugauccccgacaagggcuucgaguggaucggcuggaucaagccccuguggggcgccgugagcuacgccagacagcugcagggcagagugagcaugaccagacagcugagccaggaccccgacgaccccgacuggggcguggccuacauggaguucagcggccugacccccgccgacaccgccgaguacuucugcgugagaagaggcagcugcgacuacugcggcgacuuccccuggcaguacuggggccagggcaccguggugguggugagcagcgcc

SEQ ID NO: 33416 - RNA, 303 nt, Artificial Sequence
  derived and/or modified sequence opt4 from anti-HIV-1_LightChain
accgccggccugacccagagccccggcacccugagccugagccccggcgagagagccauccugagcugcagaaccagccaguacggcagccuggccugguaccagcagagacccggccaggcccccagacuggugaucuacgccggccugaccagagccaccggcauccccgacagauucagcggcagcagauggggcgccgaguacaaccugaccaucagcaaccuggagagcgaggacuucggcguguacuacugccagcaguacgacuucuucggccagggcaccaaggugcagguggac

SEQ ID NO: 33417 - RNA, 378 nt, Artificial Sequence
  derived and/or modified sequence opt4 from anti-HIV-1_HeavyChain
caggugcagcuggugcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgcc

SEQ ID NO: 33418 - RNA, 384 nt, Artificial Sequence
  derived and/or modified sequence opt4 from anti-HIV-1_HeavyChain
caggugcagcuggugcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugaccggcaccgugaacuucggcagccugaacuucagacagagagugagccugaccagagacagagaccuguucaccgcccacauggacaucagaggccugacccagggcgacaccgccaccuacuucugcgccagacagaaguucgagaaguacaccggcggccagggcugguacuucgaccuguggggcagaggcacccugaucguggugagcagcgcc

SEQ ID NO: 33419 - RNA, 378 nt, Artificial Sequence
  derived and/or modified sequence opt4 from anti-HIV-1_HeavyChain
caggugcagcuggugcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgcc

SEQ ID NO: 33420 - RNA, 387 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgagagcagauacaccggcggccagggcugguacuucgaccuguggggcagaggcacccacaucguggugagcagcgcc

SEQ ID NO: 33421 - RNA, 387 nt, Artificial Sequence
  derived and/or modified sequence opt4 from anti-HIV-1_HeavyChain
caggugcagcuggugcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgcc

SEQ ID NO: 33422 - RNA, 387 nt, Artificial Sequence
  derived and/or modified sequence opt4 from anti-HIV-1_HeavyChain
caggugcagcuggugcagagcggccuggaggugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgcc

SEQ ID NO: 33423 - RNA, 387 nt, Artificial Sequence
  derived and/or modified sequence opt4 from anti-HIV-1_HeavyChain
caggugcagcuggugcagagcgccagcggcgugagaagacccggcgccagcgugagagugagcugcuggaccagcgaggacaucuucgagagaagcgagcugaucuacugggugagacaggcccccggcagaggccuggaguggaucggcuggaucaagcuggugagcggcgccgugaacuucggcagcguggacuucagagacagagugagccugaccagagacagagaccuguucaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgcc

SEQ ID NO: 33424 - RNA, 375 nt, Artificial Sequence
  derived and/or modified sequence opt4 from anti-HIV-1_HeavyChain
caggugcagcuggugcagagcggcagcggcgugaagaagcccggcgccagcgugagagugagcugcuggaccagcgagggcaucuucgagaagagcgagcugauccacugggugagacaggcccccggccagggccuggaguggaucggcugggugaagaccgugaccggcgccgugaacuucggccaccagaucagcgacagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgcc

SEQ ID NO: 33425 - RNA, 378 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgcc

SEQ ID NO: 33426 - RNA, 378 nt, Artificial Sequence
  derived and/or modified sequence opt4 from anti-HIV-1_HeavyChain
caggugcagcuggugcagagcggcgccgaggugaagagacccggcgccagcgugaaggugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgcc

SEQ ID NO: 33427 - RNA, 378 nt, Artificial Sequence
  derived and/or modified sequence opt4 from anti-HIV-1_HeavyChain
caggugcagcuggugcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucaugagcggcggccagggcugguacuucgaccuguggggcagaggcaccgugaucguggugagcagcgcc

SEQ ID NO: 33428 - RNA, 387 nt, Artificial Sequence
  derived and/or modified sequence opt4 from anti-HIV-1_HeavyChain
caggugcagcuggugcccagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgcc

SEQ ID NO: 33429 - RNA, 378 nt, Artificial Sequence
  derived and/or modified sequence opt4 from anti-HIV-1_HeavyChain
caggugcagcuggugcagagcggcagcggcgugaagaaggugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucuacgccggcggccagggcugguacuucgaccuguggggcagaggcacccugaucguggugagcagcgcc

SEQ ID NO: 33430 - RNA, 387 nt, Artificial Sequence
  derived and/or modified sequence opt4 from anti-HIV-1_HeavyChain
caggugcagcuggugcagagcggcgccgaggugaagaagcccggcagcagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagcagauacagcggcgaccagggcagcuacuucgaccuguggggcagaggcacccugaucaucgugagcagcgcc

SEQ ID NO: 33431 - RNA, 375 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccagcuacuacaugcacugggugagacaggcccccggccagggccuggaguggaucggcugggugaagcccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagcgcc

SEQ ID NO: 33432 - RNA, 375 nt, Artificial Sequence
  derived and/or modified sequence opt4 from anti-HIV-1_HeavyChain
caggugcagcuggugcagagcggcgccgaggugaagaagcccggcgccagcgugcaggugagcugcaaggccagcggcuaccccuucaccaaguacuacaugcacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgcc

SEQ ID NO: 33433 - RNA, 375 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccggcuacuacaugcacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgcc

SEQ ID NO: 33434 - RNA, 402 nt, Artificial Sequence
  derived and/or modified sequence opt4 from anti-HIV-1_HeavyChain
caggugcagcuggugcagagcggcagcggcgugaagaagcccggcgccagcgugagagugagcugcagagccagcgaggaccuguucggcgacgagaucaucuacgacgacgaggugauccacuggcugagacaggugcccggccagagacccgaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagcgcc

SEQ ID NO: 33435 - RNA, 381 nt, Artificial Sequence
  derived and/or modified sequence opt4 from anti-HIV-1_HeavyChain
caggugcagcuggugcagagcggcggcggcgugaagaagcccggcgccagcgccagcuucagcugcagaaccagcgaggaccccuucgacaacgaguucuucgacagcgaguucaugcacugggugagacugacccccggccagagacccgaguggaugggcuggaugaaccccagaagcggcggcgugaacuacgccggccaguucagacccagaaugagcauguggagagacagagagcugagcaccgccuacauggagcugagagaccugaccuucgccgacaccggccuguacuucugcgccagaagaaaggaggacgacuacgacugguacuacgaccuguggggcagaggcgcccacaucaucgugagcgccgcc

SEQ ID NO: 33436 - RNA, 384 nt, Artificial Sequence
  derived and/or modified sequence opt4 from anti-HIV-1_HeavyChain
caggugcagcuggugcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgcc

SEQ ID NO: 33437 - RNA, 384 nt, Artificial Sequence
  derived and/or modified sequence opt4 from anti-HIV-1_HeavyChain
caggugcagcuggugcagagcggcgccgaggugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgcc

SEQ ID NO: 33438 - RNA, 384 nt, Artificial Sequence
  derived and/or modified sequence opt4 from anti-HIV-1_HeavyChain
caggugcagcuggugcagagcgaggccgaggugaagaagcccggcgccagcaugaccgugagcugcgagaccgccgacgaggacaucuucgacgccgccuacaugcacugggugagacaggcccccggccagaccuucgaguggcugggcuggaugaagcccgugaccggcgccgugaacuacgccagaaaguuccagggcagaaucagcuucuacagaaccagagagcuggccaucgccuacauggaccugagagaccugagauucgacgacaccgccguguacuucugcgccagaaagaccgccggcgacgugagcggcgacaacagaggcuacuucuucgaccuguggggcagaggcagcagagugaucgugagcagcgcc

SEQ ID NO: 33439 - RNA, 420 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugcugugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuacugcgccagacagaaguucgccagcagauacagcggcgaccagggcagcuacuucgaccuguggggcagaggcacccugaucaucgugagcagcgccagcaccaagggccccagcguguucccccacgaccug

SEQ ID NO: 33440 - RNA, 417 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaacggccccaucggccugccccccagaagcgcc

SEQ ID NO: 33441 - RNA, 423 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagccuguacagcgacgaccagggcagcuacuucgaccuguggggcagaggcacccugaucaucgugagcagcgccagcaccaagggccccagcagcagccccaccaucugc

SEQ ID NO: 33442 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 33443 - RNA, 411 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcagccugcaccagggccccagcggccugccccacgac

SEQ ID NO: 33444 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 33445 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuacugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 33446 - RNA, 384 nt, Artificial Sequence
  derived and/or modified sequence opt4 from anti-HIV-1_HeavyChain
caggugcaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33447 - RNA, 423 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguucccccacgaccugaga

SEQ ID NO: 33448 - RNA, 414 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguuccccaccaucugc

SEQ ID NO: 33449 - RNA, 411 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccagcuacuacaugcacugggugagacaggcccccggccagggccuggaguggaucggcugggugaagcccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagcgccagcaccaagggccccgugguguuccccaccaucugc

SEQ ID NO: 33450 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33451 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcuggaucaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33452 - RNA, 420 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagaggcggccagggcugguacuucgaccuguggggcagaggcacccugaucguggugagcagcgccagcaccgagggccccagcagaagcuucccccagauccugaga

SEQ ID NO: 33453 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucugcgugagcagcgccagccccagagcccacagaagcagccccagaagcgcc

SEQ ID NO: 33454 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugaccagaggcgacaccgccaccuacuacugcgccagacagaaguucgagagcagauacaccggcggccagggcugguacuucgaccuguggggcagaggcacccacaucguggugagcagc

SEQ ID NO: 33455 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucaucgugagcagc

SEQ ID NO: 33456 - RNA, 423 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccagcaucuucaucggcugcgacagaccccuggacaaggacuggagcggccugggcggcagcaagcugagccuggcccccagcaucuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccug

SEQ ID NO: 33457 - RNA, 399 nt, Artificial Sequence
  derived and/or modified sequence opt4 from anti-HIV-1_HeavyChain
agagaguaccuggagcagagcggcggcggcgugaagaagcugggcgccagcgugagagugagcugcagagccagcgaggaccuguucggcgacgaggugaucuacgacgacgagcugauccacuggcugagacaggugcccggccagagacccgaguggaugggcuggaucagacccaagaccggcgccagaaaccaggccagacaguuccagcccagaaucaaccugagcagagacagagcccugaacaccgccuaccuggaccugagcagccugaccagcgccgacagcgccaccuacuucugcgccagacagaccuucaagcccgacuucuacuucgccgaccagggcuggagcuucaaccuguggggcagaggcgccagagugaucgugagcagc

SEQ ID NO: 33458 - RNA, 384 nt, Artificial Sequence
  derived and/or modified sequence opt4 from anti-HIV-1_HeavyChain
caggugcaccuggugcagagcggcgccgaggugaagaagcccggcagcagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagcagauacagcggcgaccagggcagcuacuucgaccuguggggcagaggcacccugaucaucgugagcagc

SEQ ID NO: 33459 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguuccccaccaucugc

SEQ ID NO: 33460 - RNA, 441 nt, Artificial Sequence
  derived and/or modified sequence opt4 from anti-HIV-1_HeavyChain
agagaguuccuggagcagagcggcggcggcgugaagaagcugggcgccagccugagagugagcugcagagccagcgaggaccuguucggcgacgaguucaucuacgacgacgaggugauccacuggcugagacaggugcccggccagagacccgaguggaugggcuggaucagacccaagaccggcgccagaaaccaggccacccaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagcgccagcaccaagggccccagcguguucccccacgacagcgcc

SEQ ID NO: 33461 - RNA, 399 nt, Artificial Sequence
  derived and/or modified sequence opt4 from anti-HIV-1_HeavyChain
agagaguaccuggagcagagcggcggcggcgugaagaagcugggcgccagccugagagugagcugcagagccagcgaggaccuguucggcgacgagaucaucuacgacgacgaggugauccacuggcugagacaggugcccggccagagacccgaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 33462 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33463 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33464 - RNA, 414 nt, Artificial Sequence
  derived and/or modified sequence opt4 from anti-HIV-1_HeavyChain
caggcccaccuggagcagagcggcaccggcgugaagaagcccggcgccagcgugagagugagcugcuggaccagcgaggacaucuucgagaagagcgagcugauccacugggugagacaggcccccggccagggccuggaguggaucggcugggugaagaucgugagcggcgccgugaacuucggcagccccaacuucagacagagagugagccugaccagagacagagaccuguucaccgcccagauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccug

SEQ ID NO: 33465 - RNA, 399 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcggc

SEQ ID NO: 33466 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugacccacgacagagaccuguucaccgcccacauggacaucagaggccugacccagggcgacaccgccaccuacuucugcgccagacagaaguucuacgccggcggccagggcugguacuucgaccuguggggcagaggcacccugaucugcgugagcagcgccagcaccaagggccccagcggccugccccccagaagc

SEQ ID NO: 33467 - RNA, 426 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 33468 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuacugcgccagacagaaguucgagagaggcggccagggcugguacuucgaccuguggggcagaggcacccugaucguggugagcagcgccagcaccaagggccccagcguguuccccaccaucuac

SEQ ID NO: 33469 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuacugcgccagacagaaguucgagagcagauacaccggcggccagggcugguacuucgaccuguggggcagaggcacccacaucguggugagcagc

SEQ ID NO: 33470 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuacugcgccagacagaaguucuacaagggcggccagggcugguacuucgaccuguggggcagaggcacccugaucguggugagcagcgccagcaccaagggccccagcguguuccccaccaucugc

SEQ ID NO: 33471 - RNA, 399 nt, Artificial Sequence
  derived and/or modified sequence opt4 from anti-HIV-1_HeavyChain
agagaguaccuggagcagagcggcggcggcgugaagaagcccggcgccagcgugagagugagcugcagagccagcgaggaccuguucggcgacgagaucaucuacgacgacgaggugauccacuggcugagacaggugcccggccagagacccgaguggaugggcuggaucagacccaagaacggcggcagaaaccaggccagacaguuccagcccagaaucagccugaccagagacagagcccugaacaccgccuaccuggaccugaacagccugaccagcgccgacagcggcaccuacuucugcgccagacagaccuucaagcccgacuucuacuucgccgaccagggcuggagcuucaaccuguggggcagaggcgccagagugaucgugagcagc

SEQ ID NO: 33472 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33473 - RNA, 420 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguuccccaccaucugc

SEQ ID NO: 33474 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagagcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 33475 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagccccaagggccccagcggccugccccccagaagcgcc

SEQ ID NO: 33476 - RNA, 411 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccaccuacggcaucagcugggugagacaggcccccggccagggccuggaguggaucggcugggugaagaccgugaccggcgccgugaacuucggccaccagaucagcgacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 33477 - RNA, 417 nt, Artificial Sequence
  derived and/or modified sequence opt4 from anti-HIV-1_HeavyChain
caggcccagcuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 33478 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuacugcgccagacagaaguucgagagaggcggccagggcugguacuucgaccuguggggcagaggcacccugaucguggugagcagc

SEQ ID NO: 33479 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuacugcgccagacagaaguucgagagcagauacaccggcggccagggcugguacuucgaccuguggggcagaggcacccacaucguggugagcagc

SEQ ID NO: 33480 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguuccccaccaucugc

SEQ ID NO: 33481 - RNA, 381 nt, Artificial Sequence
  derived and/or modified sequence opt4 from anti-HIV-1_HeavyChain
caggugcagcuggugcagagcggcgccgaggugcagaagcccggcgccagcgugaccgugagcugcaaggccagcggcuacacccugaucagcuacggcaucagcugggugagacaggcccccggccagggccccgaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 33482 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacauccugagaaagaaggagcugauccacugggugagacaggcccccggccagggccuggaguggaucggcugggugaagaccgugaccggcaccgugaacuucggcagcagcgacuucagacagagagugagccugaccagagacagagaccuguucaccgcccacauggacaucagaggccugacccagggcgacaccgccaccuaccugugcgccagacagaaguucgagagaggcggccagggcuggaucuucgaccuguggggcagaggcacccugaucgccgugagcagcgccagcaccaagggccccagcguguucccccacgaccug

SEQ ID NO: 33483 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaacggccccaucggccugccccacagaagcgcc

SEQ ID NO: 33484 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucggcaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagccuguacagcgacgaccagggcagcuacuucgaccuguggggcagaggcacccugaucaucgugagcagc

SEQ ID NO: 33485 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcggccugccccacggcagcgcc

SEQ ID NO: 33486 - RNA, 423 nt, Artificial Sequence
  derived and/or modified sequence opt4 from anti-HIV-1_HeavyChain
caggugcaguacggcagagaggccggcgccggcaugaagaagcccggcgccagcaugaccgugagcugcaagaccgccgacgaggacaucuucgacgccgccuacaugcacagagugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcgccagcaccaagggccccagcguguuccccaccaucuac

SEQ ID NO: 33487 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 33488 - RNA, 423 nt, Artificial Sequence
  derived and/or modified sequence opt4 from anti-HIV-1_HeavyChain
caggugcagcuggugcagagcgaggccgagcugaagaagcccggcgccagcgugagcgugagcugcaaggccagcggcuacagcuucaccagcuacggcaucagcugggugagacaggugcccggccagggccuggaguggaucgccuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagcgccagcaccaagggccccagcguguucccccacgaccugaga

SEQ ID NO: 33489 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuacugcgccagacagaaguucgagagaggcggccagggcugguacuucgaccuguggggcagaggcacccugaucguggugagcagcgccagcaccaagggccccagcguguucccccacgaccug

SEQ ID NO: 33490 - RNA, 381 nt, Artificial Sequence
  derived and/or modified sequence opt4 from anti-HIV-1_HeavyChain
caggugcagcuggugcagagcggcgccgaggugcagaagcccggcgccagcgugaccgugagcugcaaggccagcggcuacacccugaucagcuacggcaucagcugggugagacaggcccccggccagggccccgaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuacugcgccagacagaccuucaagcccgacuucuacuucgccgaccagggcuggagcuucaaccuguggggcagaggcgcccacuucaucgugagcagc

SEQ ID NO: 33491 - RNA, 414 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccagaucugc

SEQ ID NO: 33492 - RNA, 378 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucugcgugagcagcgcc

SEQ ID NO: 33493 - RNA, 438 nt, Artificial Sequence
  derived and/or modified sequence opt4 from anti-HIV-1_HeavyChain
cagggcuaccuggcccagagcggcggcggcgugaagaagcccggcaccagcgccagcuucagcugcagaaccagcgacgacaucuacgacaacgaguucuucgacagcgccuucaugcacugggugagacugauccccggccagagacccgaguggaugggcuggaugaaccccagaagcggcgccgugaacuacgccagacagcugcagcccagagugagcauguacagagacagagaccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagcgccagcaccaagggccccagcgugcugccccacgaccugaga

SEQ ID NO: 33494 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugacccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguuccccagaagcgcc

SEQ ID NO: 33495 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagaaggagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccug

SEQ ID NO: 33496 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuacugcgccagacagaaguucgagagcagauacaccggcggccagggcugguacuucgaccuguggggcagaggcacccacaucguggugagcagc

SEQ ID NO: 33497 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuacugcgccagacagaaguucuacgccggcggccagggcugguacuucgaccuguggggcagaggcacccugaucguggugagcagcgccagcaccaagggccccagcguguuccccaccaucugc

SEQ ID NO: 33498 - RNA, 384 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 33499 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 33500 - RNA, 408 nt, Artificial Sequence
  derived and/or modified sequence opt4 from anti-HIV-1_HeavyChain
caggugcagcuggugcacagcggcgccgaggugaagaagcccggcgccagcaugaaggugagcugcaagaccagcggcuacagcuucaccggcuacuacaugcacugggugagacaggcccccggccagggccuggaguggaugggcuggaucaaccccagcagcaacgacaccaacuacgcccagaaguuccagggcagagugaccaugaccagagacaccagcaucaacaccgccuacauggagcugagcagacugagaagcggcgacaccgccaucuacuucugcgccagacagaaguucuacgccggcggccagggcugguacuucgaccuguggggcagaggcacccugaucguggugagcagcgccagcaccaagggccccagcguguuccccaccaucugc

SEQ ID NO: 33501 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaagauuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33502 - RNA, 414 nt, Artificial Sequence
  derived and/or modified sequence opt4 from anti-HIV-1_HeavyChain
cagggcacccuggagcagagcuggagcgaggugaagaagcugggcgccagcgugagagugagcugcuggaccagcgaggacaucuucaagaccgagcugauccacugggugagacaggcccccggccagggccuggaguggaucggcggcaugaaggccgugagcggcgccgugaacuacggcagccuggacuucagacacagagugagccugacccccgacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 33503 - RNA, 423 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucugcgugagcagcgccagcaccagagcccacagacugccccccagaagcgcc

SEQ ID NO: 33504 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagccccagagcccacagaagcagccccagaagcgcc

SEQ ID NO: 33505 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgacagcgcc

SEQ ID NO: 33506 - RNA, 414 nt, Artificial Sequence
  derived and/or modified sequence opt4 from anti-HIV-1_HeavyChain
caggcccaccuggugcagagcggcagcggcgugaagaagcccggcgccagcgugagagugagcugcuggaccagcgaggacaucuucaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 33507 - RNA, 414 nt, Artificial Sequence
  derived and/or modified sequence opt4 from anti-HIV-1_HeavyChain
caggcccagcuggagcagagcggcagcggcgugaagaagcccggcgccagcgugagagugagcugcuggaccagcgaggacaucuucaagaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 33508 - RNA, 417 nt, Artificial Sequence
  derived and/or modified sequence opt4 from anti-HIV-1_HeavyChain
caggcccaccuggagcagagcggcagagaggugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 33509 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagaaucagccugaccagagacagagaccuguucaccgcccacauggacaucagaggccugacccagggcgacaccgccaccuacuacugcgccagacagaaguucgagagcagauacaccggcggccagggcugguacuucgaccuguggggcagaggcacccacaucguggugagcagc

SEQ ID NO: 33510 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuacugcgccagacagaaguucuacaagggcggccagggcugguacuucgaccuguggggcagaggcacccugaucguggugagcagc

SEQ ID NO: 33511 - RNA, 381 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccgacuacuaccugcacugggugagacaggcccccggccagggccuggacugggugggcuggaucaaccccaacagcggcggcaccaacuacgcccagaaguuccagggcagaguggccaugaccagagacaccagccugagcagcguguaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 33512 - RNA, 414 nt, Artificial Sequence
  derived and/or modified sequence opt4 from anti-HIV-1_HeavyChain
caggccgaccuggagcagagcggcagcggcgugaagaagcccggcgccagcgugagagugagcugcuggaccagcgaggacaucuucgagagaaccaacuacgugcacugggugagacaggcccccggcagaggccuggaguggaucggcuggagcaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccug

SEQ ID NO: 33513 - RNA, 381 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33514 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 33515 - RNA, 414 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccaaccugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccug

SEQ ID NO: 33516 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccggcgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33517 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaccgugagcagc

SEQ ID NO: 33518 - RNA, 429 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcggccugccccccaccaucugcaga

SEQ ID NO: 33519 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 33520 - RNA, 417 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 33521 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagaggcagagaccuguucaccgcccacauggacaucagaggccugacccagggcgacaccgccaccuacuacugcgccagacagaaguucgagagaggcggccagggcugguacuucgaccuguggggcagaggcacccugaucguggugagcagcgccagcaccaagggccccagcguguucccccacgaccugaga

SEQ ID NO: 33522 - RNA, 411 nt, Artificial Sequence
  derived and/or modified sequence opt4 from anti-HIV-1_HeavyChain
caggcccaccugggcgccaacuggagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccagauc

SEQ ID NO: 33523 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33524 - RNA, 423 nt, Artificial Sequence
  derived and/or modified sequence opt4 from anti-HIV-1_HeavyChain
caggcccagcuggagcagagcggcgugggcgugaagaagcccggcgccagcgugagagugagcugccuggccagcgaggacaucuucaagaccgagcugauccacugggugagacaggcccccggccagggccuggaguggaucggcugggugaagaccgugaccggcgccgugaacuucggcagccagaucuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 33525 - RNA, 411 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucgcccaccagaucagcgacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguuccccaccaucugc

SEQ ID NO: 33526 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucugcgugagcagc

SEQ ID NO: 33527 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33528 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggcagaggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33529 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgagggcguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33530 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagc

SEQ ID NO: 33531 - RNA, 378 nt, Artificial Sequence
  derived and/or modified sequence opt4 from anti-HIV-1_HeavyChain
cagguguacauggagcagcccggcguggaggugaccaagcccggcgccagcgugacccugagcugcaagaccgccgaggacguguucgacgccgccuacaugcacugggugagacaggcccccggccagaccuucgaguggcugggcuggaucaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33532 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucaucgugagcagc

SEQ ID NO: 33533 - RNA, 384 nt, Artificial Sequence
  derived and/or modified sequence opt4 from anti-HIV-1_HeavyChain
caggcccaccuggugcagagcggcagcgaggugaagaagcccggcgccuucgugagagugagcugcuggaccagcgaggacaucuucgaggagaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33534 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcaaggccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33535 - RNA, 375 nt, Artificial Sequence
  derived and/or modified sequence opt4 from anti-HIV-1_HeavyChain
caggcccaccuggagcagagcggcagcgaggugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33536 - RNA, 375 nt, Artificial Sequence
  derived and/or modified sequence opt4 from anti-HIV-1_HeavyChain
caggcccaccuggugcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33537 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgagagaggcggccagggcugguacuucgaccuguggggcagaggcacccugaucugcgugagcagc

SEQ ID NO: 33538 - RNA, 375 nt, Artificial Sequence
  derived and/or modified sequence opt4 from anti-HIV-1_HeavyChain
caggcccaccuggagcagagcggcagcggcgugaagaagcccagagccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33539 - RNA, 381 nt, Artificial Sequence
  derived and/or modified sequence opt4 from anti-HIV-1_HeavyChain
caggugcagcuggagcaggccggcgccggcgugaagaagcccggccccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33540 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33541 - RNA, 381 nt, Artificial Sequence
  derived and/or modified sequence opt4 from anti-HIV-1_HeavyChain
cagguguucauggagcaggccggcgccggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33542 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagccagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33543 - RNA, 381 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacaucuucgacgccgccuacaugcacugggugagacaggccagaggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33544 - RNA, 384 nt, Artificial Sequence
  derived and/or modified sequence opt4 from anti-HIV-1_HeavyChain
caggcccaccuggagcagagcggcgccggcgugaaggagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccugcugaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33545 - RNA, 384 nt, Artificial Sequence
  derived and/or modified sequence opt4 from anti-HIV-1_HeavyChain
caggugcagcuggugcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 33546 - RNA, 384 nt, Artificial Sequence
  derived and/or modified sequence opt4 from anti-HIV-1_HeavyChain
caggcccaccuggugcagagcgccagcggcgugaagagacccggcgccagcgugagagugagcugcuggaccagcgaggacaucuucgagagaaccgagcugaucuacugggugagacaggcccccggccagggccuggaguggaucggcugggugaagaccgugagcggcgccgugaacuucggcagccaggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33547 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33548 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcuacaugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33549 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggcagaggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucugcgugagcagc

SEQ ID NO: 33550 - RNA, 375 nt, Artificial Sequence
  derived and/or modified sequence opt4 from anti-HIV-1_HeavyChain
caggcccaccuggugcagagcggcagcggcgugaagaagagcggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33551 - RNA, 378 nt, Artificial Sequence
  derived and/or modified sequence opt4 from anti-HIV-1_HeavyChain
cagguguacauggagagagccggcgccggcgugaagaagcccggcgccagcgugacccugagcugcaagaccgccgacgaggacguguucggcgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33552 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33553 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33554 - RNA, 384 nt, Artificial Sequence
  derived and/or modified sequence opt4 from anti-HIV-1_HeavyChain
caggcccaccuggugcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccguggccggcgccgugaacuucagcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33555 - RNA, 384 nt, Artificial Sequence
  derived and/or modified sequence opt4 from anti-HIV-1_HeavyChain
caggcccaccuggagcagagcggcagcggcgugaagaagagcggcgccagcgccagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33556 - RNA, 369 nt, Artificial Sequence
  derived and/or modified sequence opt4 from anti-HIV-1_HeavyChain
cugcugcagcuggugcagagcggcgccgaggugaagaagcccggcgccagcgugaaggugaccugcaaggccagcggcuacaccuucaccggcuacauccacugggugagacaggcccccggccagggccuggaguggaucggcugggugaaggccgugagcggcgccgugaacuacggcagccuggacuucagacacagagugagccugacccacgacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33557 - RNA, 369 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcugcaccuucaccggcuacuacaugcacugggugagacaggcccccggccagggccuggaguggaugggcuggaucaaccccaacagcggcggcaccaacuacgcccagaaguuccagggcagagugaccaugaccagagacaccagcaucagcaccgccuacauggagcugagcagacugagaagcgacgacaccgccguguacuacugcgccagacagaaguucgccagaggcgaccagggcugguucuucgaccuguggggcagaggcacccugaucguggugagcagc

SEQ ID NO: 33558 - RNA, 369 nt, Artificial Sequence
  derived and/or modified sequence opt4 from anti-HIV-1_HeavyChain
caggugcagcuggugcagagcggcaccgagcugagaaagcccggcgccagcgugaaggugagcugcaaggccagcggcuacaccuucagcggcagcuacauccacugggugagacaggcccccggccagggccuggagugggugggcuggaucaaccccagcagcggcgccacccagugcgccaagaaguuccaggacaaggugaccaugaccagagacaccaccaacaacaccguguacauggaggugaacagacugaucagcgacgacaccgccaccuacuucugcgccagacagaaguucgccagaggcgaccagggcugguucuucgaccuguggggcagaggcacccugaucguggugagcagc

SEQ ID NO: 33559 - RNA, 372 nt, Artificial Sequence
  derived and/or modified sequence opt4 from anti-HIV-1_HeavyChain
caggugcugcuggugcagagcggcgccgaggugaagaagcccggcagcagcgugaaggugagcugcaagaccagcggcgacagccugaccaaguacgcccugcacugggccagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33560 - RNA, 372 nt, Artificial Sequence
  derived and/or modified sequence opt4 from anti-HIV-1_HeavyChain
caggugcagcuggugcagagcggcaccgaggugaagacccccggcgccagcgugaaggugagcugcaaggccagcggcuacaccuucaccaacuacgacaucaacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33561 - RNA, 372 nt, Artificial Sequence
  derived and/or modified sequence opt4 from anti-HIV-1_HeavyChain
caggugcagcuggugcagagcggcgacgaggugaagaagcccggcgccagcgugaaggugagcugcaaggccagcggcaagggcuuccccaccagccuggugaccugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33562 - RNA, 372 nt, Artificial Sequence
  derived and/or modified sequence opt4 from anti-HIV-1_HeavyChain
caggugcagcuggugcagagcggcgccgaggugaagaagcccggcagcagcgugaaggugagcugcaagaccagcggcgacauccugaccaacuacggccugaacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33563 - RNA, 372 nt, Artificial Sequence
  derived and/or modified sequence opt4 from anti-HIV-1_HeavyChain
caggugcagcuggugcagagcggcgccgaggugaagaagcccggcgccagcgugagagugagcugcaagaccagcggcuaccccuucagcagauacggcaucagcugggugagacaggcccccggccagggccugguguggauggccugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33564 - RNA, 372 nt, Artificial Sequence
  derived and/or modified sequence opt4 from anti-HIV-1_HeavyChain
agagagcagcuggugcagagcggcgccgaggugaagaagcccggcgccagcgugaaggugagcugcaagaccagcggcaacaccuucggcagcuacgacuucaacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33565 - RNA, 372 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccagcuacuacaugcacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagc

SEQ ID NO: 33566 - RNA, 372 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccagcuacuacaugcacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33567 - RNA, 372 nt, Artificial Sequence
  derived and/or modified sequence opt4 from anti-HIV-1_HeavyChain
caggugcagcugggccagagcggcgccgagaugaagaagcccggcagcagcgugaaggugagcugcaaggccagcggcggcaccuucagacacagccccaucagcugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33568 - RNA, 369 nt, Artificial Sequence
  derived and/or modified sequence opt4 from anti-HIV-1_HeavyChain
caggugcagcuggugcagagcggcgccgaggugagaacccccggcgccagcgugaaggugagcugcaaggccagcggcuacaacuucaucgccuaccacgugcacugggugagacaggcccccggccagggccugaccuggaugggcuggaucaaccccgacagcggcgacaccguguacgcccagaacuucguggacagagugaugaugaccagaaacaccagcauccagaccguguaccuggagcugaacgugcugacccuggaggacaccgccaccuacuucugcgccagacagaaguucgccagaggcgaccagggcugguucuucgaccuguggggcagaggcacccugaucguggugagcagc

SEQ ID NO: 33569 - RNA, 372 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccguguacuacaugcacugggugagacaggcccccggcagaggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33570 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33571 - RNA, 372 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaucggcuacuacaugcacugggugagacaggcccccggccagggccuggaguggaugggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33572 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33573 - RNA, 372 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucaaggacagaaucgaccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33574 - RNA, 375 nt, Artificial Sequence
  derived and/or modified sequence opt4 from anti-HIV-1_HeavyChain
caggugcagcuggcccagagcggcgccgaggugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33575 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucagcaaggccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33576 - RNA, 372 nt, Artificial Sequence
  derived and/or modified sequence opt4 from anti-HIV-1_HeavyChain
accgcccaccuggagcagagcggcagcggcgugagaagacccggcgccagcgugagagugagcugcuggaccagcggcgacaucuucaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33577 - RNA, 372 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucaacaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33578 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33579 - RNA, 372 nt, Artificial Sequence
  derived and/or modified sequence opt4 from anti-HIV-1_HeavyChain
caggugcagcuggugcagagcggcgccgaggugaagaagcccggcgccagcgugagagugagcugcaaggccagcggcuacaccuucaccgccuacuacauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33580 - RNA, 372 nt, Artificial Sequence
  derived and/or modified sequence opt4 from anti-HIV-1_HeavyChain
caggcccaccuggagcagagcggcagcgagagcaagaagcccggcgccagcgugagagugagcugcuggagcagcgaggacaucuucaagaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33581 - RNA, 375 nt, Artificial Sequence
  derived and/or modified sequence opt4 from anti-HIV-1_HeavyChain
caggcccaccuggagcagagcggcagcgaggugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33582 - RNA, 372 nt, Artificial Sequence
  derived and/or modified sequence opt4 from anti-HIV-1_HeavyChain
caggcccaccuggagcaggugugggccggcgugaagaagcugggcgccagcgugagagugagcugcuggaccagcgaggacaucuucaagaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33583 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagcaacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33584 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33585 - RNA, 375 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33586 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcggcggcaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33587 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33588 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33589 - RNA, 375 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33590 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33591 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaaccuggugcaccagaucagcgacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33592 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagaggcagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33593 - RNA, 375 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33594 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33595 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33596 - RNA, 375 nt, Artificial Sequence
  derived and/or modified sequence opt4 from anti-HIV-1_HeavyChain
caggugcaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33597 - RNA, 372 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaagcgagcugaucuacugggugagacaggcccccggccagggccuggaguggaucggcugggugaagaccgugagcggcgccgugaaccuggcccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33598 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagagcgagcugauccacugggugagacaggcccccggccagggccuggaguggaucggcugggugaagaccgugaccggcgccgugaacuucggcagcagcgacuucagacagagagugagccugaccagagacggcgaccuguucaccgcccacauggacaucagaggccugacccagggcgacaccgccaccuacuucugcgccagacagaaguucuacgccggcggccagggcugguacuucgaccuguggggcagaggcacccugaucaucgugagcagc

SEQ ID NO: 33599 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagcgacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33600 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33601 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33602 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggccaccagaucagcgacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33603 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33604 - RNA, 372 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacauccugaagaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33605 - RNA, 372 nt, Artificial Sequence
  derived and/or modified sequence opt4 from anti-HIV-1_HeavyChain
gugagaagcguggugcagugcgaggccggcgugaagaagcccggcgccagcgugaagaucagcugcgccaccagcggcuacgccuucacccuguacuaccugcacugggugagacaggcccccggccagggccuggaguggaucggcugggugaagaccgugaccggcgccgugaacuucggcagcgccuacuucagacacagagugagccugacccccgacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33606 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugccuggacagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33607 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33608 - RNA, 375 nt, Artificial Sequence
  derived and/or modified sequence opt4 from anti-HIV-1_HeavyChain
caggcccaccuggagcagagcggcagcggcgugaagaagcugggcgccagcgugaagagcagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33609 - RNA, 375 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33610 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcuggaugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33611 - RNA, 375 nt, Artificial Sequence
  derived and/or modified sequence opt4 from anti-HIV-1_HeavyChain
caggcccaccuggagcagagcggcagcgaggugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33612 - RNA, 375 nt, Artificial Sequence
  derived and/or modified sequence opt4 from anti-HIV-1_HeavyChain
caggcccaccuggagcagagcggcgccggcgugaagaagcugggcgccagcgugagagugagcugcuggaccagcggcgacaucuucgagagaaccgagcugauccacugggugagacaggcccccggccagggccuggaguggaucggcugggugaaggccgugagcggcgccgugaacuacggcagccuggacuucagacagagagugagccugaccagagacagagaccuguucaccgcccacaucgacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33613 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcugggccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33614 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccagaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33615 - RNA, 375 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33616 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacauccugagaaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33617 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33618 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33619 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33620 - RNA, 375 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgagagaagcgagcugaucuacugggugagacaggcccccggcagaggccuggaguggaucggcuggaucaagcuggugagcggcgccgugaacuucggcagcguggacuucagagacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33621 - RNA, 375 nt, Artificial Sequence
  derived and/or modified sequence opt4 from anti-HIV-1_HeavyChain
caggcccaccuggagcagagcagaagcggcgugaagaagcccggcgccagcgugagagugagcugcuggaccagcgaggacaucuucgagagaaccgagcugauccacugggugagacaggcccccggccagggccuggaguggaucggcugggugaaggccgugagcggcgccgugaacuucggcagccccaacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33622 - RNA, 375 nt, Artificial Sequence
  derived and/or modified sequence opt4 from anti-HIV-1_HeavyChain
cagagcuaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33623 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33624 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33625 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33626 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33627 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33628 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33629 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33630 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33631 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33632 - RNA, 375 nt, Artificial Sequence
  derived and/or modified sequence opt4 from anti-HIV-1_HeavyChain
agacacaccguggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33633 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33634 - RNA, 375 nt, Artificial Sequence
  derived and/or modified sequence opt4 from anti-HIV-1_HeavyChain
agacacaccugggagcagagcggcagcggcgugaagaagcugggcgccagcgugagagugagcugcuggaccagcgaggacaucuucgagagaaccgagcugauccacugggugagacaggcccccggccagggccuggaguggaucggcuggaugaaggccgugagcggcgccgugaacuacggcagccuggacuucagacacagagugagccugaccagagacagagaccugagcaccgcccacaucgacaucagaggccugacccaggacgacaccgccaccuacuucugcgccagacagaaguucgccagaggcgaccagggcugguucuucgaccuguggggcagaggcacccugaucguggugagcagc

SEQ ID NO: 33635 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33636 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33637 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagc

SEQ ID NO: 33638 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacaugggcaucagaggccugacccagggcgacaccgccaccuacuucugcgccagacagaaguucuacgccggcggccagggcugguacuucgaccuguggggcagaggcacccugaucguggugagcagc

SEQ ID NO: 33639 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagaguguuccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33640 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33641 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccaggacuucagagacagauucagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33642 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacgccaccggccugaucuacugggugagacaggcccccggccagggccuggaguggaucggcugggugaagaucgugagcggcaccgugaacuucgccagccuggacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33643 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgccuacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33644 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuaccugugcgccagacagaaguucgccagaggcgaccagggcugguucuucgaccuguggggcagaggcacccugaucguggugagcagc

SEQ ID NO: 33645 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33646 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33647 - RNA, 375 nt, Artificial Sequence
  derived and/or modified sequence opt4 from anti-HIV-1_HeavyChain
caggcccaccccgagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33648 - RNA, 375 nt, Artificial Sequence
  derived and/or modified sequence opt4 from anti-HIV-1_HeavyChain
agagcccaccuggagcagagcggcagcggcgugagaaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33649 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33650 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33651 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccacaucguggugagcagc

SEQ ID NO: 33652 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33653 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagcagcgacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33654 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33655 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugaccgagggcgacaccgccaccuacuucugcgccagacagaaguucuacgccggcggccagggcugguacuucgaccuguggggcagaggcacccugaucguggugagcagc

SEQ ID NO: 33656 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgccaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33657 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33658 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33659 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuaccugugcgccagacagaaguucgagagaggcggccagggcuggaucuucgaccuguggggcagaggcacccugaucgccgugagcagc

SEQ ID NO: 33660 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33661 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33662 - RNA, 375 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaagcgagcugaucuacugggugagacaggcccccggccagggccuggaguggaucggcugggugaagaccgugagcggcgccgugaacuucggcagcaccgacuucagagagagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33663 - RNA, 375 nt, Artificial Sequence
  derived and/or modified sequence opt4 from anti-HIV-1_HeavyChain
caggugcaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagc

SEQ ID NO: 33664 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucugcggccugacccagggcgacaccgccaccuacuucugcgccagacagaaguucuacgccggcggccagggcugguacuucgaccuguggggcagaggcacccugaucguggugagcagc

SEQ ID NO: 33665 - RNA, 375 nt, Artificial Sequence
  derived and/or modified sequence opt4 from anti-HIV-1_HeavyChain
caggcccaccuggagcagagcggcagcggcgugaagaagcccgaggccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33666 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33667 - RNA, 375 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaaccgagcugaucuacugggugagacaggcccccggccagggccuggaguggaucggcugggugaagaccgugagcggcgccgugaacuucggcagccaggacuucagagacagauucagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33668 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33669 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccccuucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33670 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcggccugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33671 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaaggccgugagcggcaccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33672 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33673 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33674 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccacccacuucugcgccagacagaaguucgccagaggcgaccagggcugguucuucgaccuguggggcagaggcacccugaucguggugagcagc

SEQ ID NO: 33675 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33676 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33677 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33678 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33679 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgagggcaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucgccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33680 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagagccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucuacgccggcggccagggcugguacuucgaccuguggggcagaggcacccugaucguggugagcagc

SEQ ID NO: 33681 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33682 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuacggcagccugaacuucagaagcagaaucagccugaccagagacagagaccuguucaccgcccacauggacaucagaggccugaccgagggcgacaccgccaccuacuucugcgccagacagaaguucuacgccggcggccagggcugguacuucgaccuguggggcagaggcacccugaucguggugagcagc

SEQ ID NO: 33683 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33684 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucagaugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33685 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccagauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33686 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucgcccaccagaucagcgacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33687 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagguggugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33688 - RNA, 375 nt, Artificial Sequence
  derived and/or modified sequence opt4 from anti-HIV-1_HeavyChain
caggugcaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33689 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33690 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33691 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuaccugugcgccagacagaaguucgagagaggcggccagggcugguacuucgaccuguggggcagaggcacccugaucguggugagcagc

SEQ ID NO: 33692 - RNA, 372 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33693 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugaccgagggcgacaccgccaccuacuucugcgccagacagaaguucuacgccggcggccagggcugguacuucgaccuguggggcagaggcacccugaucguggugagcagc

SEQ ID NO: 33694 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33695 - RNA, 375 nt, Artificial Sequence
  derived and/or modified sequence opt4 from anti-HIV-1_HeavyChain
caggcccaccuggagcagagcggccccggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33696 - RNA, 375 nt, Artificial Sequence
  derived and/or modified sequence opt4 from anti-HIV-1_HeavyChain
agagcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33697 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33698 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33699 - RNA, 375 nt, Artificial Sequence
  derived and/or modified sequence opt4 from anti-HIV-1_HeavyChain
caggcccaccuggagcagagcggcagcggcgugaagaaggugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33700 - RNA, 375 nt, Artificial Sequence
  derived and/or modified sequence opt4 from anti-HIV-1_HeavyChain
caggugcagcuggugcagagcggcgccgagcugaagaagcccggcagcagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33701 - RNA, 375 nt, Artificial Sequence
  derived and/or modified sequence opt4 from anti-HIV-1_HeavyChain
caggcccaccuggagcagagcggcagcggcgugaagaagcccggcgugagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33702 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaagguggugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33703 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccgccuacuucugcgccagacagaaguucgccagaggcgaccagggcugguucuucgaccuguggggcagaggcacccugaucguggugagcagc

SEQ ID NO: 33704 - RNA, 375 nt, Artificial Sequence
  derived and/or modified sequence opt4 from anti-HIV-1_HeavyChain
caggcccaccuggagcagagcggcagcggcgugagaaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33705 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33706 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33707 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33708 - RNA, 375 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33709 - RNA, 375 nt, Artificial Sequence
  derived and/or modified sequence opt4 from anti-HIV-1_HeavyChain
caggcccaccuggagcagagcgccagcggcgugagaagacccggcgccagcgugagagugagcugcuggaccagcgaggacaucuucgagagaagcgagcugaucuacugggugagacaggcccccggcagaggccuggaguggaucggcuggaucaagcuggugagcggcgccgugaacuucggcagcguggacuucagagacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33710 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33711 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33712 - RNA, 375 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacaugggcaucagaggccugacccagggcgacaccgccaccuacuucugcgccagacagaaguucuacgccggcggccagggcugguacuucgaccuguggggcagaggcacccugaucguggugagcagc

SEQ ID NO: 33713 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33714 - RNA, 375 nt, Artificial Sequence
  derived and/or modified sequence opt4 from anti-HIV-1_HeavyChain
cagagccaccuggagcagagcggcagcgccaugaagaagcugggcgccagcgugagagugcccugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33715 - RNA, 375 nt, Artificial Sequence
  derived and/or modified sequence opt4 from anti-HIV-1_HeavyChain
caggugcaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33716 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33717 - RNA, 375 nt, Artificial Sequence
  derived and/or modified sequence opt4 from anti-HIV-1_HeavyChain
caggcccaccuggagcagagcgccagcggcgugagaagacccggcgccagcgugagagugagcugcuggaccagcgaggacaucuucgagagaagcgagcugaucuacugggugagacaggcccccggcagaggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33718 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33719 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucuacgccggcggccagggcugguacuucgaccuguggggcagaggcacccugaucguggugagcagc

SEQ ID NO: 33720 - RNA, 375 nt, Artificial Sequence
  derived and/or modified sequence opt4 from anti-HIV-1_HeavyChain
caggugcagcuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33721 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggcagaggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33722 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33723 - RNA, 375 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaagcgagcugaucuacugggugagacaggcccccggccagggccuggaguggaccggcugggugaagaccgugagcggcgccgugaacuucggcagcaccgacuucagagagagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33724 - RNA, 375 nt, Artificial Sequence
  derived and/or modified sequence opt4 from anti-HIV-1_HeavyChain
caggugcaccuggagcagagcggcagcggcgugaagaagcugggcgccagcgugagagugagcugcuggaccagcgaggacaucuucgagagaaccgagcugauccacugggugagacaggcccccggcagaggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33725 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagc

SEQ ID NO: 33726 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33727 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcggcaccgccaccuacuucugcgccagacagaaguucuacgccggcggccagggcugguacuucgaccuguggggcagaggcacccugaucguggugagcagc

SEQ ID NO: 33728 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucugcggccugacccagggcgacaccgccaccuacuucugcgccagacagaaguucgagagaggcggccagggcugguacuucgaccuguggggcagaggcacccugaucguggugagcagc

SEQ ID NO: 33729 - RNA, 375 nt, Artificial Sequence
  derived and/or modified sequence opt4 from anti-HIV-1_HeavyChain
caggcccaccuggagcagagcggcagcggcgugagaaaggugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33730 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagc

SEQ ID NO: 33731 - RNA, 375 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33732 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggccugagcgacuucagacagagagugagccugaccagagacagaggccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33733 - RNA, 375 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33734 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgagagaggcggccagggcugguacuucgaccuguggggcagaggcacccugaucguggugagcagc

SEQ ID NO: 33735 - RNA, 375 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33736 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagcagcgacuucagaaacagaaucagccugagcagagacagagaccugagcaccgcccacauggacaucagaggccugacccaggacgacaccgccaccuacuucugcgccagacagaaguucgagagaggcggccagggcuggaucuucgaccuguggggcagaggcacccugaucgccgugagcagc

SEQ ID NO: 33737 - RNA, 375 nt, Artificial Sequence
  derived and/or modified sequence opt4 from anti-HIV-1_HeavyChain
caggugcagcuggugcagagcggcaccgaggugaagaagcccggcgccagcgugagagugagcugcaaggccagcggcuacaccuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33738 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagaggcggccagggcuggaucuucgaccuguggggcagaggcacccugaucgccgugagcagc

SEQ ID NO: 33739 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33740 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33741 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33742 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcuggugcacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33743 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33744 - RNA, 375 nt, Artificial Sequence
  derived and/or modified sequence opt4 from anti-HIV-1_HeavyChain
caggcccacagagagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33745 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugccuggccagcgaggacaucuucaagaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33746 - RNA, 375 nt, Artificial Sequence
  derived and/or modified sequence opt4 from anti-HIV-1_HeavyChain
caggcccaccuggagcagagcggcagcggcgugaagaaggugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgagagaggcggccagggcuggaucuucgaccuguggggcagaggcacccugaucgccgugagcagc

SEQ ID NO: 33747 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33748 - RNA, 375 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaagcgagcugaucuacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33749 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagc

SEQ ID NO: 33750 - RNA, 375 nt, Artificial Sequence
  derived and/or modified sequence opt4 from anti-HIV-1_HeavyChain
caggugcagcuggugcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33751 - RNA, 375 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33752 - RNA, 372 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaaccuggcccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33753 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33754 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagcagcgacuucagaaacagaaucagccugagcagagacagagaccugagcaccgcccacauggacaucagaggccugacccagggcgacaccgccaccuacuucugcgccagacagaaguacuacgccggcggccagggcugguacuucgaccuguggggcagaggcacccugaucguggugagcagc

SEQ ID NO: 33755 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33756 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33757 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33758 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggcagaggccuggaguggaucggcugggugaaggccgugagcggcgccgugaacuacggcagccuggacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33759 - RNA, 375 nt, Artificial Sequence
  derived and/or modified sequence opt4 from anti-HIV-1_HeavyChain
caggccagacccggcaccagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33760 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugaccgagggcgacaccgccaccuacuucugcgccagacagaaguucgagagaggcggccagggcuggaucuucgaccuguggggcagaggcacccugaucgccgugagcagc

SEQ ID NO: 33761 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaaggccaucagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33762 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacagcggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33763 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagagccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33764 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccuggugaccgugagcagc

SEQ ID NO: 33765 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccugaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33766 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33767 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagc

SEQ ID NO: 33768 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgccagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33769 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgagagaggcggccagggcugguacuucgaccuguggggcagaggcacccugaucguggugagcagc

SEQ ID NO: 33770 - RNA, 375 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaagcgagcugaucuacugggugagacaggcccccggccagggccuggaguggaucggcugggugaagaccgugagcggcgccgugaacuucggcagcaccgacuucagagagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33771 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcguggugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33772 - RNA, 375 nt, Artificial Sequence
  derived and/or modified sequence opt4 from anti-HIV-1_HeavyChain
caggcccaccuggagcagagcggcagcggcgugaagaaggugggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33773 - RNA, 375 nt, Artificial Sequence
  derived and/or modified sequence opt4 from anti-HIV-1_HeavyChain
caggccuaccuggagcagagcggcagcaucaugaagaagcccggcgccagcgugagagugagcugcuggaccagcgaggacaucuucgacagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33774 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacuggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33775 - RNA, 375 nt, Artificial Sequence
  derived and/or modified sequence opt4 from anti-HIV-1_HeavyChain
gaggcccaccuggagcagagcggcagcggcgugaagaagcccggcgccagcgugagagugagcugcuggaccagcgaggacaucuucgagagaaccgagcugacccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33776 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuacgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33777 - RNA, 375 nt, Artificial Sequence
  derived and/or modified sequence opt4 from anti-HIV-1_HeavyChain
caggugcaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33778 - RNA, 375 nt, Artificial Sequence
  derived and/or modified sequence opt4 from anti-HIV-1_HeavyChain
caggcccaccuggagcagagcggcagcggcgugaagaaggugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33779 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcccccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33780 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgagagaggcggccagggcuggaucuucgaccuguggggcagaggcacccugaucgccgugagcagc

SEQ ID NO: 33781 - RNA, 375 nt, Artificial Sequence
  derived and/or modified sequence opt4 from anti-HIV-1_HeavyChain
caggcccaccuggagcagagcggcagcggcgugagaaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33782 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggcagaggccuggaguggaucggcugggugaaggccgugagcggcgccgugaacuacggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33783 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcgcccugaucguggugagcagc

SEQ ID NO: 33784 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33785 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33786 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagcagcgacuucagaaacagaaucagccugagcagagacagagaccugagcaccgcccacauggacaucagaggccugacccaggacgacaccgccaccuacuucugcgccagacagaaguucuacgccggcggccagggcugguacuucgaccuguggggcagaggcacccugaucguggugagcagc

SEQ ID NO: 33787 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33788 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33789 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacgccgccaccuacuucugcgccagacagaaguucgagagaggcggccagggcugguacuucgaccuguggggcagaggcacccugaucguggugagcagc

SEQ ID NO: 33790 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggcagaggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucuacgccggcggccagggcugguacuucgaccuguggggcagaggcacccugaucguggugagcagc

SEQ ID NO: 33791 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucgccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33792 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccuggcccagggcgacaccgccaccuacuucugcgccagacagaaguucgagagaggcggccagggcugguacuucgaccuguggggcagaggcacccugaucguggugagcagc

SEQ ID NO: 33793 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagcagcgacuucagaaacagaaucagccugagcagagacagagaccugagcaccgcccacauggacaucagaggccugacccaggacgacaccgccaccuacuucugcgccagacagaaguucgagagaggcggccagggcugguacuucgaccuguggggcagaggcacccugaucguggugagcagc

SEQ ID NO: 33794 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33795 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33796 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagaagagcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33797 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33798 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33799 - RNA, 375 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33800 - RNA, 375 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucuacgccggcggccagggcugguacuucgaccuguggggcagaggcacccugaucguggugagcagc

SEQ ID NO: 33801 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccggccugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33802 - RNA, 375 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacguguucgagagaaccgagcugauccacugggugagacaggcccccggccagggccuggaguggaucggcugggugaagaccgugaucggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33803 - RNA, 372 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucaagaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33804 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccgacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33805 - RNA, 375 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagaaucagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33806 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33807 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaccggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33808 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccccacccaggacgacaccgccaccuacuucugcgccagacagaaguucgccagaggcgaccagggcugguucuucgaccuguggggcagaggcacccugaucguggugagcagc

SEQ ID NO: 33809 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33810 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33811 - RNA, 375 nt, Artificial Sequence
  derived and/or modified sequence opt4 from anti-HIV-1_HeavyChain
agacacaccuggaacgagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33812 - RNA, 375 nt, Artificial Sequence
  derived and/or modified sequence opt4 from anti-HIV-1_HeavyChain
caggcccaccuggagcagagcggcgccggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33813 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaaggccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33814 - RNA, 375 nt, Artificial Sequence
  derived and/or modified sequence opt4 from anti-HIV-1_HeavyChain
caggcccaccugggcaccauccugggccuggagagcaagaagcccggcgccagcgugagagugagcugcuggaccagcgaggacaucuucgagagaaccgagcugauccacugggugagacaggcccccggccagggccuggaguggaucggcugggugaagaccgugaccggcgccagcauccuggcccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33815 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagcccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33816 - RNA, 375 nt, Artificial Sequence
  derived and/or modified sequence opt4 from anti-HIV-1_HeavyChain
agagugcaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33817 - RNA, 375 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacagagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33818 - RNA, 375 nt, Artificial Sequence
  derived and/or modified sequence opt4 from anti-HIV-1_HeavyChain
caggugcagcuggugcagagcggcgccgaggugaagagacccggcgccagcgugaaggugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33819 - RNA, 375 nt, Artificial Sequence
  derived and/or modified sequence opt4 from anti-HIV-1_HeavyChain
agacacgaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33820 - RNA, 375 nt, Artificial Sequence
  derived and/or modified sequence opt4 from anti-HIV-1_HeavyChain
agacacaccugggagcagguguggagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33821 - RNA, 375 nt, Artificial Sequence
  derived and/or modified sequence opt4 from anti-HIV-1_HeavyChain
agacacaccuggaacaagagcggcagcggcgugaagaagcccggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33822 - RNA, 375 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33823 - RNA, 375 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucgagaccaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33824 - RNA, 375 nt, Artificial Sequence
  derived and/or modified sequence opt4 from anti-HIV-1_HeavyChain
agacacgaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33825 - RNA, 375 nt, Artificial Sequence
  derived and/or modified sequence opt4 from anti-HIV-1_HeavyChain
agacacaccugggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33826 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugccuggccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33827 - RNA, 375 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33828 - RNA, 375 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33829 - RNA, 375 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccacggcgacaccgccaccuacuucugcgccagacagaaguucgagagaggcggccagggcugguacuucgaccuguggggcagaggcacccugaucguggugagcagc

SEQ ID NO: 33830 - RNA, 375 nt, Artificial Sequence
  derived and/or modified sequence opt4 from anti-HIV-1_HeavyChain
agacacaccugggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33831 - RNA, 375 nt, Artificial Sequence
  derived and/or modified sequence opt4 from anti-HIV-1_HeavyChain
caggcccaccuggagcagagcggcgccggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33832 - RNA, 375 nt, Artificial Sequence
  derived and/or modified sequence opt4 from anti-HIV-1_HeavyChain
caggcccaccuggagcagagcggcagcggcgugaagaagcccggcgccagcguggaggugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 33833 - RNA, 372 nt, Artificial Sequence
  derived and/or modified sequence opt4 from anti-HIV-1_HeavyChain
caggcccaccuggagcagagcggcgccggcgugaagaagcugggcgccagcgugagagugagcugcuggaccagcgaggacaucuucaagaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33834 - RNA, 375 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33835 - RNA, 375 nt, Artificial Sequence
  derived and/or modified sequence opt4 from anti-HIV-1_HeavyChain
agacacaccugggagagaaucuggagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33836 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaagacugacccaggacgacaccgccaccuacuucugcgccagacagaaguucgccagaggcgaccagggcugguucuucgaccuguggggcagaggcacccugaucguggugagcagc

SEQ ID NO: 33837 - RNA, 375 nt, Artificial Sequence
  derived and/or modified sequence opt4 from anti-HIV-1_HeavyChain
agacacaccguggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33838 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugacccccgacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33839 - RNA, 375 nt, Artificial Sequence
  derived and/or modified sequence opt4 from anti-HIV-1_HeavyChain
agacacaccguggagcagagcggcagcggcgugaagaaggugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33840 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcugggccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33841 - RNA, 375 nt, Artificial Sequence
  derived and/or modified sequence opt4 from anti-HIV-1_HeavyChain
agacacaccugggagcagguguggagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33842 - RNA, 375 nt, Artificial Sequence
  derived and/or modified sequence opt4 from anti-HIV-1_HeavyChain
agacacaccuggagacagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcguggugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33843 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcggcgacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33844 - RNA, 375 nt, Artificial Sequence
  derived and/or modified sequence opt4 from anti-HIV-1_HeavyChain
agacacaccguggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33845 - RNA, 375 nt, Artificial Sequence
  derived and/or modified sequence opt4 from anti-HIV-1_HeavyChain
caggcccaccuggagcagagcggcagcggcgugaagaagagaugggccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33846 - RNA, 375 nt, Artificial Sequence
  derived and/or modified sequence opt4 from anti-HIV-1_HeavyChain
agacacaccguggagcagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33847 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagaggccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33848 - RNA, 375 nt, Artificial Sequence
  derived and/or modified sequence opt4 from anti-HIV-1_HeavyChain
caggugcaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgccaacuucggcagcagcgacuucagacagagagugagccugacccccgacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 33849 - RNA, 375 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgacaccaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33850 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcagagacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33851 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugccuggccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33852 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggcccagcgaggacaucuucgagagaaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33853 - RNA, 375 nt, Artificial Sequence
  derived and/or modified sequence opt4 from anti-HIV-1_HeavyChain
agagcccaccuggagcagagcggcagcgaguggaagaagcugggcgccagcgugagagugagcugcuggaccagcggcgacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33854 - RNA, 375 nt, Artificial Sequence
  derived and/or modified sequence opt4 from anti-HIV-1_HeavyChain
agacacaccguggagcagagcggcagcggcgugaagaagcugggcgccagcgugaacgugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33855 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagcccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33856 - RNA, 375 nt, Artificial Sequence
  derived and/or modified sequence opt4 from anti-HIV-1_HeavyChain
agacacaccuggaacaagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33857 - RNA, 375 nt, Artificial Sequence
  derived and/or modified sequence opt4 from anti-HIV-1_HeavyChain
caggcccacagcgagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33858 - RNA, 375 nt, Artificial Sequence
  derived and/or modified sequence opt4 from anti-HIV-1_HeavyChain
caggcccaccuggagcagagcggcgccggcgugaagagacccggcgccagcgugagagugagcugcuggaccagcgaggacaucuucgagaccaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33859 - RNA, 375 nt, Artificial Sequence
  derived and/or modified sequence opt4 from anti-HIV-1_HeavyChain
ggccacaccugggagcagagcggcgccggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33860 - RNA, 375 nt, Artificial Sequence
  derived and/or modified sequence opt4 from anti-HIV-1_HeavyChain
ggcacccccggcagcgagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33861 - RNA, 375 nt, Artificial Sequence
  derived and/or modified sequence opt4 from anti-HIV-1_HeavyChain
ggcacccccggcagcgagagcggcagcggcgugaagaugcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33862 - RNA, 375 nt, Artificial Sequence
  derived and/or modified sequence opt4 from anti-HIV-1_HeavyChain
agacacaccugggagcagagcggcgccggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33863 - RNA, 375 nt, Artificial Sequence
  derived and/or modified sequence opt4 from anti-HIV-1_HeavyChain
ggcacccccggcaacaagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33864 - RNA, 375 nt, Artificial Sequence
  derived and/or modified sequence opt4 from anti-HIV-1_HeavyChain
caggcccaccuggagcagagcggcgccggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33865 - RNA, 375 nt, Artificial Sequence
  derived and/or modified sequence opt4 from anti-HIV-1_HeavyChain
ggcacccccggcaacaagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33866 - RNA, 375 nt, Artificial Sequence
  derived and/or modified sequence opt4 from anti-HIV-1_HeavyChain
ggcacccccggcaacaagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 33867 - RNA, 375 nt, Artificial Sequence
  derived and/or modified sequence opt4 from anti-HIV-1_HeavyChain
caggcccaccuggagcagagcgccagcggcgugaagagacccggcggcugggugagagugagcugcuggaccagcgaggacaucuucgagagaagcgagcugaucuacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33868 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccagcagcggcgccgugaacuucggcagccccaacuucagaaccagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33869 - RNA, 375 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33870 - RNA, 375 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33871 - RNA, 375 nt, Artificial Sequence
  derived and/or modified sequence opt4 from anti-HIV-1_HeavyChain
ggcaccaccuggaacaagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33872 - RNA, 375 nt, Artificial Sequence
  derived and/or modified sequence opt4 from anti-HIV-1_HeavyChain
agacacaccuggaacgagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33873 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcggcaacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33874 - RNA, 378 nt, Artificial Sequence
  derived and/or modified sequence opt4 from anti-HIV-1_HeavyChain
agaugcagcauggagcagcccggcuggagcgagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33875 - RNA, 375 nt, Artificial Sequence
  derived and/or modified sequence opt4 from anti-HIV-1_HeavyChain
agacacaccagcgagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagc

SEQ ID NO: 33876 - RNA, 375 nt, Artificial Sequence
  derived and/or modified sequence opt4 from anti-HIV-1_HeavyChain
agacacaccguggagcagagcggcgccggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33877 - RNA, 375 nt, Artificial Sequence
  derived and/or modified sequence opt4 from anti-HIV-1_HeavyChain
ggcacccccuggaacgagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33878 - RNA, 375 nt, Artificial Sequence
  derived and/or modified sequence opt4 from anti-HIV-1_HeavyChain
agacacgaccuggagcccagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucgug

SEQ ID NO: 33879 - RNA, 375 nt, Artificial Sequence
  derived and/or modified sequence opt4 from anti-HIV-1_HeavyChain
agacacaccguggagcagagcggcagcggcgugaagaagcugggcgccagcgugagagugagcugccuggccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33880 - RNA, 375 nt, Artificial Sequence
  derived and/or modified sequence opt4 from anti-HIV-1_HeavyChain
caggcccaccuggagcagagcggcagcgagagcaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33881 - RNA, 375 nt, Artificial Sequence
  derived and/or modified sequence opt4 from anti-HIV-1_HeavyChain
ggcacccccggcagcgagagcgccagcggcgugagaagacccggcgccagcgugagagugagcugcuggaccagcgaggacaucuucgagagaagcgagcugaucuacugggugagacaggcccccggcagaggccuggaguggaucggcuggaucaagcuggugagcggcgccgugaacuucggcagcguggacuucagagacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33882 - RNA, 375 nt, Artificial Sequence
  derived and/or modified sequence opt4 from anti-HIV-1_HeavyChain
caggugcaccuggagcagagcggcagcggcgugaagaagcccggcgccagcgugagagugagcugcuggaccagcgaggacaucuucgagaagagcgagcugauccagugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33883 - RNA, 375 nt, Artificial Sequence
  derived and/or modified sequence opt4 from anti-HIV-1_HeavyChain
ggcacccccggcagcgagagcggcagcggcgugaagaaggugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgccagaauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33884 - RNA, 375 nt, Artificial Sequence
  derived and/or modified sequence opt4 from anti-HIV-1_HeavyChain
ggcacccccggcagcgagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33885 - RNA, 372 nt, Artificial Sequence
  derived and/or modified sequence opt4 from anti-HIV-1_HeavyChain
agagcccaccuggagcagagcggcgccggcgugaagaagcccggcggcugggugagagugagcugcuggaccagcgaggacaucuucaagaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33886 - RNA, 378 nt, Artificial Sequence
  derived and/or modified sequence opt4 from anti-HIV-1_HeavyChain
caggugcagcugaugcagagcggcgccgaggugaagagacccggcgccagcgugaagaucagcugcaccgccagcggcuucacccugaccgaccacuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33887 - RNA, 378 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaacuucaccggcuacuaccugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33888 - RNA, 375 nt, Artificial Sequence
  derived and/or modified sequence opt4 from anti-HIV-1_HeavyChain
ggcacccccggcagcaagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33889 - RNA, 378 nt, Artificial Sequence
  derived and/or modified sequence opt4 from anti-HIV-1_HeavyChain
caggugcagcuggugcagagcggcgccgagcugaagaagcccggcgccagcgugaaggugagcugcgaggccagcggcuacagcuucaccgaccaccacauccacugggugagacaggcccccggccagggccuggaguggcugggcuggaugaaccccaacaacggcgacaccgccuacgcccagaccuuccugggcagagugaccaugaccagagacaccagcaucaacaccgccuacauggagcugagcagacugaccagcgacgacaccgccguguacuucugcgccagaaagaccgccggcgacgugagcggcgacaagagaggcuucuucuucgaccuguggggcagaggcagcagagugaucgugagcagc

SEQ ID NO: 33890 - RNA, 378 nt, Artificial Sequence
  derived and/or modified sequence opt4 from anti-HIV-1_HeavyChain
cagguguacaugagcagcagaggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33891 - RNA, 378 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccgccuacuacaugcacuggcugagacaggcccccggccagggccuggaguggaugggcuggaucaacccccacagcggcggcaccaacuucgcccagaaguuccagggcagagugaccaugaccagagacaccagcaucaccaccgccuacauggagcugagcagacugagaagcgacgacaccgccaccuacuucugcgccagacagaaguucgccagcagauacagcggcgaccagggcagcuacuucgaccuguggggcagaggcacccugaucguggugagcagc

SEQ ID NO: 33892 - RNA, 375 nt, Artificial Sequence
  derived and/or modified sequence opt4 from anti-HIV-1_HeavyChain
agagcccaccuggagcagagcggcgccggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 33893 - RNA, 378 nt, Artificial Sequence
  derived and/or modified sequence opt4 from anti-HIV-1_HeavyChain
caggugagacuggugcagagcggcgccgacgugaagcagcccggcgccagcgugaaggugagcugcaaggccagcggcuacaccuucaccgacuacuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33894 - RNA, 378 nt, Artificial Sequence
  derived and/or modified sequence opt4 from anti-HIV-1_HeavyChain
caggcccaccugggcaacaagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 33895 - RNA, 381 nt, Artificial Sequence
  derived and/or modified sequence opt4 from anti-HIV-1_HeavyChain
cagguguacauggagcagagcggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcaccagaaagaccgccggcgacgugagcggcgacaagagaggcuucuucuucgaccuguggggcagaggcagcagagugaucgugagcagc

SEQ ID NO: 33896 - RNA, 381 nt, Artificial Sequence
  derived and/or modified sequence opt4 from anti-HIV-1_HeavyChain
cagguguacguggagcagcccggcggcggcgugaagaagcccggcgccagcgugacccugagcugcaagaccgccgacgaggacguguucgacgccaccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33897 - RNA, 381 nt, Artificial Sequence
  derived and/or modified sequence opt4 from anti-HIV-1_HeavyChain
cagguguacauggagcaggccggcguggagguggagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33898 - RNA, 381 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33899 - RNA, 381 nt, Artificial Sequence
  derived and/or modified sequence opt4 from anti-HIV-1_HeavyChain
caggugcacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33900 - RNA, 381 nt, Artificial Sequence
  derived and/or modified sequence opt4 from anti-HIV-1_HeavyChain
cagguguacauggagcaggccggcgccgaggugaagaagcccggcgccagcgugacccugagcugcgagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33901 - RNA, 381 nt, Artificial Sequence
  derived and/or modified sequence opt4 from anti-HIV-1_HeavyChain
cagguguacauggagcagcccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33902 - RNA, 372 nt, Artificial Sequence
  derived and/or modified sequence opt4 from anti-HIV-1_HeavyChain
gccacccccuggaacaagagcggcagcggcgugaagaagcccggcgccagcgugagagugagcugcuggaccagcgaggacaucuucgagagaaccgagcugagccuggugagacaggcccccggccagggccuggaguggaucggcuggaugaagaccgugaccggcgccgugaacuucggcagccccaacuucagacacggcgugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33903 - RNA, 381 nt, Artificial Sequence
  derived and/or modified sequence opt4 from anti-HIV-1_HeavyChain
cagguguacauggagcaggccggcgccggcaugaagaagcccggcgccagcaugaccgccagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33904 - RNA, 378 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccggcuacuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaaggccgacgugagcggcgacgacagaggcuucuucuucgaccuguggggcagaggcaccagagugaucgugagcagc

SEQ ID NO: 33905 - RNA, 381 nt, Artificial Sequence
  derived and/or modified sequence opt4 from anti-HIV-1_HeavyChain
agaguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucaccaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33906 - RNA, 381 nt, Artificial Sequence
  derived and/or modified sequence opt4 from anti-HIV-1_HeavyChain
cagguguacauggagcagagcggcggcggcgugaagaagcccggccccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33907 - RNA, 378 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccggcuacuacauccacuggaugagacaggcccccggccagggccuggaguggaugggcuggaucaaccccaacagcggcgccgugagcuacgccagaaaguuccagggcagagugagcuuccugcacgaccagggcaucagaauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33908 - RNA, 381 nt, Artificial Sequence
  derived and/or modified sequence opt4 from anti-HIV-1_HeavyChain
caggugcacauggagcaggccggcguggagguggagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33909 - RNA, 381 nt, Artificial Sequence
  derived and/or modified sequence opt4 from anti-HIV-1_HeavyChain
cagguguacauggagcaggccggcgccggcgugaagaagcccggcgccagcgccacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33910 - RNA, 375 nt, Artificial Sequence
  derived and/or modified sequence opt4 from anti-HIV-1_HeavyChain
ggccacgaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagc

SEQ ID NO: 33911 - RNA, 378 nt, Artificial Sequence
  derived and/or modified sequence opt4 from anti-HIV-1_HeavyChain
caggcccacagaggcaccaucuggggccuggaggugaagaagcccggcggcugggugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 33912 - RNA, 381 nt, Artificial Sequence
  derived and/or modified sequence opt4 from anti-HIV-1_HeavyChain
caggugcacauggagcaggccggcgccggcguggagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33913 - RNA, 381 nt, Artificial Sequence
  derived and/or modified sequence opt4 from anti-HIV-1_HeavyChain
cagguguacauggagcagagcggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33914 - RNA, 381 nt, Artificial Sequence
  derived and/or modified sequence opt4 from anti-HIV-1_HeavyChain
cagguguacauggagcagagcggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33915 - RNA, 381 nt, Artificial Sequence
  derived and/or modified sequence opt4 from anti-HIV-1_HeavyChain
gagguguacauggagcagagcggcggcggcgugaagaagcccggcgccagcgugacccugagcugcaagaccgccagcgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33916 - RNA, 381 nt, Artificial Sequence
  derived and/or modified sequence opt4 from anti-HIV-1_HeavyChain
caggugcagcuggugcagagcggcgccgaggugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33917 - RNA, 381 nt, Artificial Sequence
  derived and/or modified sequence opt4 from anti-HIV-1_HeavyChain
cagguguucauggagcagagcggcggcggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33918 - RNA, 381 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagaagauuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33919 - RNA, 381 nt, Artificial Sequence
  derived and/or modified sequence opt4 from anti-HIV-1_HeavyChain
cagguguacauggagcaggccggcgccggcgugaagaagcccggcgccagcgugacccugagcugcaaggccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33920 - RNA, 381 nt, Artificial Sequence
  derived and/or modified sequence opt4 from anti-HIV-1_HeavyChain
cagguguucauggagcaggccggcgccggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33921 - RNA, 381 nt, Artificial Sequence
  derived and/or modified sequence opt4 from anti-HIV-1_HeavyChain
cagguguacauggagcagcccggcggcgaggugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33922 - RNA, 381 nt, Artificial Sequence
  derived and/or modified sequence opt4 from anti-HIV-1_HeavyChain
caggugcacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33923 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggccccagagugaucgugagcagc

SEQ ID NO: 33924 - RNA, 381 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggccacaccuucaccaacuacgacaucaacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 33925 - RNA, 381 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacaccgaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33926 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33927 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcccggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33928 - RNA, 381 nt, Artificial Sequence
  derived and/or modified sequence opt4 from anti-HIV-1_HeavyChain
cagguguacauggagcaggccggcggcggcgugaagaagcccggcgccagcgccacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33929 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugagaugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33930 - RNA, 381 nt, Artificial Sequence
  derived and/or modified sequence opt4 from anti-HIV-1_HeavyChain
caggugcagcuggugcagagcggcgccgaggugaagaagcccggcgccagcgugaaggugagcugcagagccagcggcuacaccuucggcaaccacgccaucagcugggugagacaggcccccggccagggccuggaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 33931 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggccccggcagcagagugaucgugagcagc

SEQ ID NO: 33932 - RNA, 381 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33933 - RNA, 381 nt, Artificial Sequence
  derived and/or modified sequence opt4 from anti-HIV-1_HeavyChain
caggugcacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33934 - RNA, 381 nt, Artificial Sequence
  derived and/or modified sequence opt4 from anti-HIV-1_HeavyChain
cagguguacauggagcaggccggcgacggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33935 - RNA, 381 nt, Artificial Sequence
  derived and/or modified sequence opt4 from anti-HIV-1_HeavyChain
caggugcagcuggugcagagcggcgccgaggugaagaagcccggcgccagcgugacccugagcugcaagaccgccgacgaggacguguucgacgccgccuacaugcacugggugagacaggcccagggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33936 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagccaggugaucgugagcagc

SEQ ID NO: 33937 - RNA, 381 nt, Artificial Sequence
  derived and/or modified sequence opt4 from anti-HIV-1_HeavyChain
caggugcagcuggugcagagcggcgccgaggugagaaagcccggcgccagcgugaaggugagcugcaaggccagcggcuacaccuucaccaacuacuacaugcacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 33938 - RNA, 381 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33939 - RNA, 381 nt, Artificial Sequence
  derived and/or modified sequence opt4 from anti-HIV-1_HeavyChain
cugauccaccuggcccagagcggcgccgaggugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33940 - RNA, 381 nt, Artificial Sequence
  derived and/or modified sequence opt4 from anti-HIV-1_HeavyChain
caggugcagcuggugcagagcggcgccgaggugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33941 - RNA, 381 nt, Artificial Sequence
  derived and/or modified sequence opt4 from anti-HIV-1_HeavyChain
cagguguacauggagcagggcagaggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33942 - RNA, 381 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaagagcgacgacaccgccguguacuucugcgccagaaagaccgccggcgacgugagcggcgacaagagaggcuucuucuucgaccuguggggcagaggcagcagagugaucgugagcagc

SEQ ID NO: 33943 - RNA, 381 nt, Artificial Sequence
  derived and/or modified sequence opt4 from anti-HIV-1_HeavyChain
caggugcagcuggugcagagcggcgccgaggugaagaagcccggcagcagcaucaaggugagcugcaaggccagcggcgacaccaucagcagauacgccaucaacugggugagacaggcccccggccagggccuggaguggaucggcugggugaagaccgugaccggcgccgugaacuucggcagccuggacuucagacacagaaucagccugaccagagacagagaccuguucaccgcccacaugggcaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33944 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacaucuucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33945 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaacuuccagggcagagugagcuucuacagaaccagagagcugggcaucgccuacauggaccugagaaaccugagauucgacgacaccgccguguacuucugcgccagacagaaguucgagagcagauacagcggcgaccagggcagcuacuucgaccuguggggcagaggcacccugaucaucgugagcagc

SEQ ID NO: 33946 - RNA, 381 nt, Artificial Sequence
  derived and/or modified sequence opt4 from anti-HIV-1_HeavyChain
cagguguacauggagcaggccggcggcggcgugaagagacccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33947 - RNA, 381 nt, Artificial Sequence
  derived and/or modified sequence opt4 from anti-HIV-1_HeavyChain
caggugcagcuggugcagagcggcgacgaggugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33948 - RNA, 381 nt, Artificial Sequence
  derived and/or modified sequence opt4 from anti-HIV-1_HeavyChain
caggugcagcuggugcagagcggcgccggcgugaagaagcccggcagcagcgugaaggugagcugcaaggccagcggcggcaccuucagcagcuacgccaucaacuggcugagacaggugcccggccagagacccgaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 33949 - RNA, 381 nt, Artificial Sequence
  derived and/or modified sequence opt4 from anti-HIV-1_HeavyChain
cagguguacauggagagagccggcggcggcgugaagaagcccggcgccagcgugacccugagcugcgagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33950 - RNA, 381 nt, Artificial Sequence
  derived and/or modified sequence opt4 from anti-HIV-1_HeavyChain
cagguguacauggagcaggccggcgccggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuuccugcaggaccagggcaucagaaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33951 - RNA, 381 nt, Artificial Sequence
  derived and/or modified sequence opt4 from anti-HIV-1_HeavyChain
cagguguacaugggcgccggcagaggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33952 - RNA, 381 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagcccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33953 - RNA, 381 nt, Artificial Sequence
  derived and/or modified sequence opt4 from anti-HIV-1_HeavyChain
caggugcagcuggugcagagcggcgccgaggugaagaagcccggcgccagcgugaagaucagcugcaaggccagcggcuacaccuucaucagacacggcauccacuggcugagacaggugcccggccagagacccgaguggaugggcuggaucagacccaagaccggcgccagaaaccaggccagacaguuccagcccagaaucagccuggccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 33954 - RNA, 381 nt, Artificial Sequence
  derived and/or modified sequence opt4 from anti-HIV-1_HeavyChain
caggugcugcuggugcagagcggcgccgaggugaagaagcccggcagcagcgugaaggugagcugcaaggccagcggcgacagccugaccaaguacgccuucagcugggugagacaggcccccggccagggccccgaguggaugggcuggaucagacccaagaccggcgccagaaacagagccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 33955 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggccagaggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33956 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33957 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggccccggcagcagagugaucgugagcagc

SEQ ID NO: 33958 - RNA, 381 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacaucuucgacgccgccuacaugagaugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33959 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuaccuggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33960 - RNA, 381 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccggcuacuacaugcacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33961 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaucaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33962 - RNA, 381 nt, Artificial Sequence
  derived and/or modified sequence opt4 from anti-HIV-1_HeavyChain
cagguguacauggagcaggccggcggcggcaugaagaagcccggcgccagcgugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33963 - RNA, 381 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucagcaaggccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33964 - RNA, 381 nt, Artificial Sequence
  derived and/or modified sequence opt4 from anti-HIV-1_HeavyChain
cagguguacauggaggccggcagaggcggcgugaagaagcccggcgccagcgccacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33965 - RNA, 381 nt, Artificial Sequence
  derived and/or modified sequence opt4 from anti-HIV-1_HeavyChain
agaugcaucuggagacaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33966 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaucaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33967 - RNA, 384 nt, Artificial Sequence
  derived and/or modified sequence opt4 from anti-HIV-1_HeavyChain
cagagccaccuggagcagagcggcagcgccaugaagaagcccggcgccagcgugaagagcagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 33968 - RNA, 381 nt, Artificial Sequence
  derived and/or modified sequence opt4 from anti-HIV-1_HeavyChain
agaugccuguggagacaggccggcggcggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33969 - RNA, 381 nt, Artificial Sequence
  derived and/or modified sequence opt4 from anti-HIV-1_HeavyChain
agaugcaucugggagagagccggcggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33970 - RNA, 381 nt, Artificial Sequence
  derived and/or modified sequence opt4 from anti-HIV-1_HeavyChain
caggugcagcuggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33971 - RNA, 381 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33972 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugagaugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33973 - RNA, 381 nt, Artificial Sequence
  derived and/or modified sequence opt4 from anti-HIV-1_HeavyChain
cagguguacauggagcagcccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33974 - RNA, 381 nt, Artificial Sequence
  derived and/or modified sequence opt4 from anti-HIV-1_HeavyChain
cagguguacauggagcaggccggcggcgaggugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33975 - RNA, 381 nt, Artificial Sequence
  derived and/or modified sequence opt4 from anti-HIV-1_HeavyChain
caggugcagcuggugcagagcggcgccgaggugaagaagcccggcgccagcgugagagugagcugccaggccagcggcuacaucuucaccggcuacuucgugaacuggcugagacagcugcccggccagagacccgaguggaugggcuggaucagacccaagagcggcgccagaaaccaggccagacaguuccagcccagaaucagccugaccagagacagagcccugagcaccgccuaccuggacagcaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 33976 - RNA, 381 nt, Artificial Sequence
  derived and/or modified sequence opt4 from anti-HIV-1_HeavyChain
ggcugcaucuggacccaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33977 - RNA, 381 nt, Artificial Sequence
  derived and/or modified sequence opt4 from anti-HIV-1_HeavyChain
agaugcaucuggagacaggccggcggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33978 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgagugggugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 33979 - RNA, 381 nt, Artificial Sequence
  derived and/or modified sequence opt4 from anti-HIV-1_HeavyChain
cagguguacauggagcaggccggcggcggcgugaaggagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 33980 - RNA, 381 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucaagaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33981 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcuggaugaagaccgugaccggcgccgugaacuucggcagccuggacuucagacacagaaucagccugaccagagacagagaccuguucaccgcccacauggacaucagaggccuggcccagggcgacaccgccaccuacuucugcgccagacagaaguucgagagcagauacaccggcggccagggcugguacuucgaccuguggggcagaggcacccacaucguggugagcagc

SEQ ID NO: 33982 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33983 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 33984 - RNA, 384 nt, Artificial Sequence
  derived and/or modified sequence opt4 from anti-HIV-1_HeavyChain
agccacaccuggaacaacagaggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 33985 - RNA, 381 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuuccacaacgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 33986 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcuggaugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33987 - RNA, 381 nt, Artificial Sequence
  derived and/or modified sequence opt4 from anti-HIV-1_HeavyChain
cagguguucauggagcaggccggcggcgaggugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33988 - RNA, 381 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgaggacgagcugauccacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 33989 - RNA, 381 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacauccugaaggccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 33990 - RNA, 381 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacagcuucaccgacuacuacauccacuggcugagacaggugcagggccagagacccgaguggaugggcuggaucagacccagaaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 33991 - RNA, 381 nt, Artificial Sequence
  derived and/or modified sequence opt4 from anti-HIV-1_HeavyChain
cagguguucauggagcaggccggcggcgaggugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 33992 - RNA, 384 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33993 - RNA, 384 nt, Artificial Sequence
  derived and/or modified sequence opt4 from anti-HIV-1_HeavyChain
caggcccaccuggagcagagcggcgccggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33994 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcugggccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 33995 - RNA, 381 nt, Artificial Sequence
  derived and/or modified sequence opt4 from anti-HIV-1_HeavyChain
agaugcagacuggugcagagcggcgccgaggugaagaagcccggcgccagcgugagagugagcugccaggccagcggcuacaccuucagcgccuacggcgugaacugggugagacaggcccccggccaggagcuggaguggaucggcugggugaagaccgugaccggcgccgugaacuucggcagccccaacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33996 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugugccaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33997 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaucgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 33998 - RNA, 384 nt, Artificial Sequence
  derived and/or modified sequence opt4 from anti-HIV-1_HeavyChain
caggugcagcuggugcagagcggccuggaggugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 33999 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugagacaggacgacaccgccaccuacuucugcgccagacagaaguucgagagcagauacagcggcgaccagggcagcuacuucgaccuguggggcagaggcacccugaucaucgugagcagc

SEQ ID NO: 34000 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgccagcagauacagcggcgaccagggcagcuacuucgaccuguggggcagaggcacccugaucguggugagcagc

SEQ ID NO: 34001 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34002 - RNA, 384 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34003 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgagagcagauacaccggcggccagggcugguacuucgaccuguggggcagaggcacccacaucguggugagcagc

SEQ ID NO: 34004 - RNA, 384 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgagagcagauacaccggcggccagggcugguacuucgaccuguggggcagaggcacccacaucguggugagcagc

SEQ ID NO: 34005 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34006 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccgacuucagacacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34007 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggcagaggccuggaguggaucggcugggugaagaccgugagcggcaccgugaacuucggcagcagcgacuucagaaacagagugagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34008 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34009 - RNA, 384 nt, Artificial Sequence
  derived and/or modified sequence opt4 from anti-HIV-1_HeavyChain
cagagccaccuggagcagagcggcagcgccaugaagagacccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34010 - RNA, 384 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34011 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagacuucuucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34012 - RNA, 381 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34013 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagccuguacagcgacgaccagggcagcuacuucgaccuguggggcagaggcacccugaucaucgugagcagc

SEQ ID NO: 34014 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34015 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagcagcgacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34016 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34017 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34018 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucggcaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34019 - RNA, 384 nt, Artificial Sequence
  derived and/or modified sequence opt4 from anti-HIV-1_HeavyChain
caggugcagcuggugcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34020 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgagggcaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34021 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggccagacaggcccccggccagggccuggaguggaucggcugggugaagaccgugaccggcgccgugaacuucggcagccccaacuucagacacagagccagccugaccagagacagagaccuguucaccgcccacauggacaucagaggccugaccgagggcgacaccgccaccuacuucugcgccagacagaaguucgccagcagauacagcggcgaccagggcagcuacuucgaccuguggggcagaggcacccugaucaucgugagcagc

SEQ ID NO: 34022 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccgccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugagacaggacgacaccgccaccuacuucugcgccagacagaaguucgagagcagauacagcggcgaccagggcagcuacuucgaccuguggggcagaggcacccugaucaucgugagcagc

SEQ ID NO: 34023 - RNA, 384 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucgagugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgagagcagauacaccggcggccagggcugguacuucgaccuguggggcagaggcacccacaucguggugagcagc

SEQ ID NO: 34024 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccuggacugcgugagcagc

SEQ ID NO: 34025 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcgccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34026 - RNA, 384 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34027 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34028 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccugaacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34029 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34030 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34031 - RNA, 384 nt, Artificial Sequence
  derived and/or modified sequence opt4 from anti-HIV-1_HeavyChain
caggccagacuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34032 - RNA, 384 nt, Artificial Sequence
  derived and/or modified sequence opt4 from anti-HIV-1_HeavyChain
caggcccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34033 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34034 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgccaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34035 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34036 - RNA, 381 nt, Artificial Sequence
  derived and/or modified sequence opt4 from anti-HIV-1_HeavyChain
agaugcaucuggagacaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagaggcaucagaauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 34037 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34038 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34039 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcgccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34040 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgccagcagauacagcggcgaccagggcagcuacuucgaccuguggggcagaggcacccugaucguggugagcagc

SEQ ID NO: 34041 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcaccagacagaaguucgagagcagauacaccggcggccagggcugguacuucgaccuguggggcagaggcacccacaucguggugagcagc

SEQ ID NO: 34042 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccccgaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34043 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcccccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34044 - RNA, 384 nt, Artificial Sequence
  derived and/or modified sequence opt4 from anti-HIV-1_HeavyChain
cagagccaccuggagcagagcggccccgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34045 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagaggccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34046 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgccagcagauacagcggcgaccagggcagcuacuucgaccuguggggcagaggcacccugaucaucgugagcagc

SEQ ID NO: 34047 - RNA, 384 nt, Artificial Sequence
  derived and/or modified sequence opt4 from anti-HIV-1_HeavyChain
cagagccaccuggagcacagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34048 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagccuguacagcgacgaccagggcagcuacuucgaccuguggggcagaggcacccugaucaucgugagcagc

SEQ ID NO: 34049 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34050 - RNA, 384 nt, Artificial Sequence
  derived and/or modified sequence opt4 from anti-HIV-1_HeavyChain
caggcccaccuggagcagagcgccagcggcgugagaagacccggcgccagcgugagagugagcugcuggaccagcgaggacaucuucgagagaagcgagcugaucuacugggugagacaggcccccggcagaggccuggaguggaucggcuggaucaagcuggugagcggcgccgugaacuucggcagcguggacuucagaaacagaaucagccugagcagagacagagaccugagcaccgcccacauggacaucagaggccugagacaggacgacaccgccaccuacuucugcgccagacagaaguucgagagcagauacagcggcgaccagggcagcuacuucgaccuguggggcagaggcacccugaucaucgugagcagc

SEQ ID NO: 34051 - RNA, 384 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaaccgagcugaucuacugggugagacaggcccccggccagggccuggaguggaucggcugggugaagaccgugagcggcgccgugaacuucggcagccaggacuucagagacagauucagccugaccagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34052 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34053 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34054 - RNA, 384 nt, Artificial Sequence
  derived and/or modified sequence opt4 from anti-HIV-1_HeavyChain
cagagccaccugaagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34055 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34056 - RNA, 384 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgagagcagauacaccggcggccagggcugguacuucgaccuguggggcagaggcacccacaucguggugagcagc

SEQ ID NO: 34057 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34058 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacauccuggagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34059 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucgccagcagauacagcggcgaccagggcagcuacuucgaccuguggggcagaggcacccugaucguggugagcagc

SEQ ID NO: 34060 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34061 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgacgacaucuucgagagaaccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34062 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34063 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34064 - RNA, 384 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaaccgagcugaucuacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34065 - RNA, 384 nt, Artificial Sequence
  derived and/or modified sequence opt4 from anti-HIV-1_HeavyChain
caggcccaccuggagcagagcgccagcggcgugagaagacccggcgccagcgugagagugagcugcuggaccagcgaggacaucuucgagagaagcgagcugaucuacugggugagacaggcccccggcagaggccuggaguggaucggcuggaucaagcuggugagcggcgccgugaacuucggcagcguggacuucagagacagagugagccugaccagagacagagaccuguucaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34066 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34067 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34068 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccccaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccugaucguggugagcagc

SEQ ID NO: 34069 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugcccaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34070 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgccagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34071 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34072 - RNA, 384 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugagacaggacgacaccgccaccuacuucugcgccagacagaaguucgagagcagauacagcggcgaccagggcagcuacuucgaccuguggggcagaggcacccugaucaucgugagcagc

SEQ ID NO: 34073 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34074 - RNA, 384 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaagcgagcugaucuacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34075 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagccuguacagcgacgaccagggcagcuacuucgaccuguggggcagaggcacccugaucaucgugagcagc

SEQ ID NO: 34076 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucguggugagcagc

SEQ ID NO: 34077 - RNA, 384 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34078 - RNA, 381 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacauccugagaaagagcgagcugauccacugggugagacaggcccccggccagggccuggaguggaucggcugggugaagaccgugaccggcgccgugaacuucggccaccagaucagcgacagagugagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34079 - RNA, 384 nt, Artificial Sequence
  derived and/or modified sequence opt4 from anti-HIV-1_HeavyChain
cccgcccaccuggagcagagcggcagcggcgugaagaagcccggcgccagcgugagagugagcugcugggccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34080 - RNA, 384 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaagcgagcugaucuacugggugagacaggcccccggccagggccuggaguggaucggcugggugaagaccgugagcggcgccgugaacuucggcagcaccgacuucagagagagaaucagccugagcagagacagagaccugagcaccgccuacauggacaucagaggccugacccaggacgacgccgccaccuacuucugcgccagacagaaguucgccagcagauacagcggcgaccagggcagcuacuucgaccuguggggcagaggcacccugaucguggugagcagc

SEQ ID NO: 34081 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggaccugagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34082 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccugaucguggugagcagc

SEQ ID NO: 34083 - RNA, 384 nt, Artificial Sequence
  derived and/or modified sequence opt4 from anti-HIV-1_HeavyChain
agccacgaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34084 - RNA, 384 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34085 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgccagcagauacagcggcgaccagggcagcuacuucgaccuguggggcagaggcacccugaucguggugagcagc

SEQ ID NO: 34086 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagcagcgacuucagaaacagaaucagccugagcagagacagagaccugagcaccgcccacaugggcaucagaggccugagacaggacgacaccgccaccuacuucugcgccagacagaaguucgagagcagauacagcggcgaccagggcagcuacuucgaccuguggggcagaggcacccugaucaucgugagcagc

SEQ ID NO: 34087 - RNA, 384 nt, Artificial Sequence
  derived and/or modified sequence opt4 from anti-HIV-1_HeavyChain
gaggugcagcuggugcagagcggcgccgacgugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34088 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugcaccaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34089 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagcccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34090 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34091 - RNA, 384 nt, Artificial Sequence
  derived and/or modified sequence opt4 from anti-HIV-1_HeavyChain
caggcccaccuggagcagagcgccagcggcgugagaagacccggcgccagcgugagagugagcugcuggaccagcgaggacaucuucgagagaagcgagcugaucuacugggugagacaggcccccggcagaggccuggaguggaucggcuggaucaagcuggugagcggcgccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34092 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34093 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccugggcuggaucggcugggugaagaucgugagcggcaccgugaacuucgccagccuggacuucagaagcagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34094 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggccaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34095 - RNA, 384 nt, Artificial Sequence
  derived and/or modified sequence opt4 from anti-HIV-1_HeavyChain
caggcccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34096 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34097 - RNA, 384 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34098 - RNA, 384 nt, Artificial Sequence
  derived and/or modified sequence opt4 from anti-HIV-1_HeavyChain
agccacaaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34099 - RNA, 384 nt, Artificial Sequence
  derived and/or modified sequence opt4 from anti-HIV-1_HeavyChain
agccacaccuggaacaacagaggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34100 - RNA, 384 nt, Artificial Sequence
  derived and/or modified sequence opt4 from anti-HIV-1_HeavyChain
agccacaccuggaacgagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34101 - RNA, 384 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuacggcagccugaacuucagaagcagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34102 - RNA, 384 nt, Artificial Sequence
  derived and/or modified sequence opt4 from anti-HIV-1_HeavyChain
caggcccaccuggagcagagcggcagcggcgugaagaagcccggcgccagcgugaaggugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34103 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34104 - RNA, 384 nt, Artificial Sequence
  derived and/or modified sequence opt4 from anti-HIV-1_HeavyChain
ggccacgaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34105 - RNA, 384 nt, Artificial Sequence
  derived and/or modified sequence opt4 from anti-HIV-1_HeavyChain
agccacaccuggaacaacagaggcagcgccaugaagaagcccggcgccagcgugagagugagcugcuggaccagcgaggacaucuucgacaccaccgagcugaucuacugggugagacaggcccccggccagggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34106 - RNA, 384 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34107 - RNA, 384 nt, Artificial Sequence
  derived and/or modified sequence opt4 from anti-HIV-1_HeavyChain
agccacaccuggaacaacagaggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34108 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugccuggccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34109 - RNA, 384 nt, Artificial Sequence
  derived and/or modified sequence opt4 from anti-HIV-1_HeavyChain
cagagccaccuggagcagagcggcgccgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugagacaggacgacaccgccaccuacuucugcgccagacagaaguucgagagcagauacagcggcgaccagggcagcuacuucgaccuguggggcagaggcacccugaucaucgugagcagc

SEQ ID NO: 34110 - RNA, 384 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34111 - RNA, 384 nt, Artificial Sequence
  derived and/or modified sequence opt4 from anti-HIV-1_HeavyChain
agccacaccuggaacgagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34112 - RNA, 384 nt, Artificial Sequence
  derived and/or modified sequence opt4 from anti-HIV-1_HeavyChain
agacacaccuggaacgagagcggcagcggcgugaagaagcccggcgccagcgugagagugagcugcuggagcagcgaggacaucuucgagagaaccgagcugauccacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34113 - RNA, 384 nt, Artificial Sequence
  derived and/or modified sequence opt4 from anti-HIV-1_HeavyChain
cagagccaccuggagcagagcggcagcgagaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34114 - RNA, 384 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccagggcgacaccgccaccuacuucugcgccagacagaaguucgagagccuguacagcgacgaccagggcagcuacuucgaccuguggggcagaggcacccugaucaucgugagcagc

SEQ ID NO: 34115 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccagaucuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34116 - RNA, 384 nt, Artificial Sequence
  derived and/or modified sequence opt4 from anti-HIV-1_HeavyChain
agccacaccuggaacaagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34117 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccagaucuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggccccacccuguucgugagcagc

SEQ ID NO: 34118 - RNA, 384 nt, Artificial Sequence
  derived and/or modified sequence opt4 from anti-HIV-1_HeavyChain
caggcccaccuggagcagagcgccagcggcgugagaagacccggcgccagcgugagagugagcugcuggaccagcgaggacaucuucgagagaagcgagcugaucuacugggugagacaggcccccggcagaggccuggaguggaucggcuggaucaagaccugcagcggcgccgugaacuucggcagcguggacuucagagacagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34119 - RNA, 384 nt, Artificial Sequence
  derived and/or modified sequence opt4 from anti-HIV-1_HeavyChain
agccacaccguggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34120 - RNA, 384 nt, Artificial Sequence
  derived and/or modified sequence opt4 from anti-HIV-1_HeavyChain
agacacaccuggaacaagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34121 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagagacuggaguggaucggcugggugaagaccgugaccggcgccgugaacuucggcagccccaacuucagacacagagugagccugaccagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34122 - RNA, 384 nt, Artificial Sequence
  derived and/or modified sequence opt4 from anti-HIV-1_HeavyChain
agccacgaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugagacaggacgacaccgccaccuacuucugcgccagacagaaguucgagagcagauacagcggcgaccagggcagcuacuucgaccuguggggcagaggcacccugaucaucgugagcagc

SEQ ID NO: 34123 - RNA, 384 nt, Artificial Sequence
  derived and/or modified sequence opt4 from anti-HIV-1_HeavyChain
agacacaccuggaacgagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccaccaccuacuucugcgccagacagaaguucgagagcagauacaccggcggccagggcugguacuucgaccuguggggcagaggcacccacaucguggugagcagc

SEQ ID NO: 34124 - RNA, 384 nt, Artificial Sequence
  derived and/or modified sequence opt4 from anti-HIV-1_HeavyChain
agacacaccugggagcagguguggagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34125 - RNA, 384 nt, Artificial Sequence
  derived and/or modified sequence opt4 from anti-HIV-1_HeavyChain
cagagccaccuggagcagagcggcagcgccaugaagaagcccggcgccagcgugaccgugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34126 - RNA, 384 nt, Artificial Sequence
  derived and/or modified sequence opt4 from anti-HIV-1_HeavyChain
agacacgaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34127 - RNA, 384 nt, Artificial Sequence
  derived and/or modified sequence opt4 from anti-HIV-1_HeavyChain
gugaccaccuggaacaagagcggcagcgccaugaagaagcccggcgccagcgugagagugagcugcuggaccagcgaggacaucuucgacaccaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34128 - RNA, 384 nt, Artificial Sequence
  derived and/or modified sequence opt4 from anti-HIV-1_HeavyChain
agacacaccuggaacaacaccggcagcggcgugaagaagcccggcgccagcgugagagugagcugccuggccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34129 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugccuggccagcgaggacaucuucgagagaaccgagcugaucuacugggugagacaggcccccggcagaggccccgaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34130 - RNA, 384 nt, Artificial Sequence
  derived and/or modified sequence opt4 from anti-HIV-1_HeavyChain
agacacaccuggaacaacaccggcagcggcgugaagaagcccggcgccagcgugagagugagcugcuggaccagcgacgacaucuucgagagaaccgagcugauccacugggugagacaggcccccggccagggccuggaguggaucggcugggugaagaccgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34131 - RNA, 384 nt, Artificial Sequence
  derived and/or modified sequence opt4 from anti-HIV-1_HeavyChain
ggcacccccggcaacaagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34132 - RNA, 384 nt, Artificial Sequence
  derived and/or modified sequence opt4 from anti-HIV-1_HeavyChain
ggcacccccggcagcgagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34133 - RNA, 384 nt, Artificial Sequence
  derived and/or modified sequence opt4 from anti-HIV-1_HeavyChain
gugacccccggcaccaaccugggccugagaaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34134 - RNA, 384 nt, Artificial Sequence
  derived and/or modified sequence opt4 from anti-HIV-1_HeavyChain
agacacgaccuggagcagagcggcgccggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34135 - RNA, 384 nt, Artificial Sequence
  derived and/or modified sequence opt4 from anti-HIV-1_HeavyChain
caggugcaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugacccccgacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34136 - RNA, 384 nt, Artificial Sequence
  derived and/or modified sequence opt4 from anti-HIV-1_HeavyChain
ggcaccaccugggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34137 - RNA, 384 nt, Artificial Sequence
  derived and/or modified sequence opt4 from anti-HIV-1_HeavyChain
agccacgaccuggagcagagcggcagcgaguggaagaagcccggcgccagcgugagagugagcugcuggaccagcgaggacaucuucgacaccaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34138 - RNA, 384 nt, Artificial Sequence
  derived and/or modified sequence opt4 from anti-HIV-1_HeavyChain
cagagcagacccggcaacaagagcggcagcgccaugaagaagcccggcgccagcgugagagugagcugcuggaccagcgaggacaucuucgagagaaccgagcugcugugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagc

SEQ ID NO: 34139 - RNA, 384 nt, Artificial Sequence
  derived and/or modified sequence opt4 from anti-HIV-1_HeavyChain
ggcaccaccuggagcaagagcggcagcggcgugaagaagcccggcgccagcgugagagugagcugcuggaccagcgaggacaucuucgagagaaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34140 - RNA, 387 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacauccugagaaagaagagaguggacagcgugggcugcgacaccgcccccggccagggccuggaguggaucggcugggugaagaccgugaccggcgccgugaacuucggcagcagcgacuucagacagagagugagccugaccagagacagagaccuguucaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34141 - RNA, 387 nt, Artificial Sequence
  derived and/or modified sequence opt4 from anti-HIV-1_HeavyChain
aaggcccaccugggcaacaagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34142 - RNA, 384 nt, Artificial Sequence
  derived and/or modified sequence opt4 from anti-HIV-1_HeavyChain
accaccgugggcaccauccugggcagagccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34143 - RNA, 384 nt, Artificial Sequence
  derived and/or modified sequence opt4 from anti-HIV-1_HeavyChain
cagagccaccuggagcagagcggcagcgccaugaagaagcccggcgccagcgugaaggugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34144 - RNA, 387 nt, Artificial Sequence
  derived and/or modified sequence opt4 from anti-HIV-1_HeavyChain
cagagccaccuggagcaggugugggugugccagagcaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34145 - RNA, 384 nt, Artificial Sequence
  derived and/or modified sequence opt4 from anti-HIV-1_HeavyChain
agacacaccguggagcagagcggcagcggcgugaagaagcccggcgccagcgugagagugagcugcuggagcagcgaggacaucuucgagagaaccgagcugauccacugggugagacaggcccccggccagggccuggaguggaugggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34146 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcagcgccagagaggacaucuucgacaccaccgagcugaucuacugggugagacaggcccccggccagggccuggaguggaucggcugggugaagaucgugugcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34147 - RNA, 387 nt, Artificial Sequence
  derived and/or modified sequence opt4 from anti-HIV-1_HeavyChain
gaggugcagagaggcggcagaguggugggcagagacgugaagaagcccggcgccagcgugagagugagcugcuggaccagcgaggacaucuuccacaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34148 - RNA, 384 nt, Artificial Sequence
  derived and/or modified sequence opt4 from anti-HIV-1_HeavyChain
ggcaccaccuggaacgagagcggcagcggcgugaagaagcccggcgccagcgugagagugcccugcuggagcagcgaggacaucuucgagagaaccgagcugauccacagagugagacaggcccccggccagggccuggaguggaucggcugggugaagaccgugaccggcgccgugaacuucggcagccccaacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34149 - RNA, 384 nt, Artificial Sequence
  derived and/or modified sequence opt4 from anti-HIV-1_HeavyChain
agaagcaacugggugcagagcggcgccgacgugaagaagcccggcgccagcgugaagagcagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34150 - RNA, 384 nt, Artificial Sequence
  derived and/or modified sequence opt4 from anti-HIV-1_HeavyChain
cccgugcagcuggugcagagcggcgccgaggugaagaagcccggcgccagcgugaaggugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34151 - RNA, 399 nt, Artificial Sequence
  derived and/or modified sequence opt4 from anti-HIV-1_HeavyChain
agagaguaccuggagcagagcggcggcggcgugaagaagcugggcgccagcgugagagugagcugcagagccagcgaggaccuguucggcgacgaggccaucuacgacgacgagcugauccacuggcugagacaggugcccggccagagacccgaguggaugggcuggaucagacccaagaccggcgccagaaaccaggccagacaguuccagcccagaaucaaccugagcagagacagagcccugaacaccgccuaccuggaccugagcagccugaccagcgccgacagcgccaccuacuucugcgccagacagaccuucaagcccgacuucuacuucgccgaccagggcuggagcuucaaccuguggggcagaggcgccagagugaucgugagcagc

SEQ ID NO: 34152 - RNA, 399 nt, Artificial Sequence
  derived and/or modified sequence opt4 from anti-HIV-1_HeavyChain
caggugcagcuggugcagagcggcaccgaggugaagaagcccggcgccagccugagagugagcugcagagccagcgaggaccuguucggcgacaagaucaucuacgacgacgaggugauccacuggcugagacagcugcccggccagagacccgaguggaugggcuggaucagacccaagagcggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 34153 - RNA, 399 nt, Artificial Sequence
  derived and/or modified sequence opt4 from anti-HIV-1_HeavyChain
caggcccaccuggagcagagcggcagcggcgugaagaagcccggcgccagcgugagagugagcugcagagccagcgaggaccuguucggcgacgagaucaucuacgacgacgaggugauccacuggcugagacaggugcccggccagagacccgaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 34154 - RNA, 399 nt, Artificial Sequence
  derived and/or modified sequence opt4 from anti-HIV-1_HeavyChain
ggcaacaucuggagcgagagcggcggcggcgugaagaagcccggcgccagcgugagagugagcugcagagccagcgaggaccuguucggcgacgagaucaucuacgacgacgaggugauccacuggcugagacaggugcccggccagagacccgaguggaugggcuggaucagacccaagaacggcggcagaaaccaggccagacaguuccagcccagaaucagccugaccagagacagagcccugaacaccgccuaccuggaccugaacagccugaccagcgccgacagcggcaccuacuucugcgccagacagaccuucaagcccgacuucuacuucgccgaccagggcuggagcuucaaccuguggggcagaggcgccagagugaucgugagcagc

SEQ ID NO: 34155 - RNA, 399 nt, Artificial Sequence
  derived and/or modified sequence opt4 from anti-HIV-1_HeavyChain
caggugcagcuggugcagagcggcgccgaggugaagaagcccggcgccagccugagagugcccugcagagccagcgaggaccuguucggcgacgagaucaucuacgacgacgaggugauccacuggcugagacaggugcccggccagagacccgaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 34156 - RNA, 390 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcagaagcgcc

SEQ ID NO: 34157 - RNA, 393 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccagaagcacc

SEQ ID NO: 34158 - RNA, 414 nt, Artificial Sequence
  derived and/or modified sequence opt4 from anti-HIV-1_HeavyChain
caggugcagcuggugcagagcggcgccgaggugaagaagcccggcgccagcgugaccgugagcugcaaggccagcagauacaccuucaucaacuacuacauccacugggugagacaggcccccggccagggccuggaguggaucggcugggugaagcccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34159 - RNA, 414 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccaucaccagacacuacaugcacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34160 - RNA, 408 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagcgccagcaccaagggccccagcgacgaccugaga

SEQ ID NO: 34161 - RNA, 411 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguacgaccugaga

SEQ ID NO: 34162 - RNA, 417 nt, Artificial Sequence
  derived and/or modified sequence opt4 from anti-HIV-1_HeavyChain
caggugcagcuggugcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34163 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguuccccaccaucuacgug

SEQ ID NO: 34164 - RNA, 417 nt, Artificial Sequence
  derived and/or modified sequence opt4 from anti-HIV-1_HeavyChain
caggugcagcuggagcagagcggcagcggcgugaagaagcugggcgccagcgugagagugagcugcuggaccagcgaggacaucuucgaggacgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcggccugcaccagggccccaucggccugccccccagacugagcaga

SEQ ID NO: 34165 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagccccagagcccacagaagcagccccaccaucugcgug

SEQ ID NO: 34166 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34167 - RNA, 414 nt, Artificial Sequence
  derived and/or modified sequence opt4 from anti-HIV-1_HeavyChain
caggugcaccuggugcagagcggcgccgaggugaagagacccggcgccagcgugaaggugagcugcaaggccagcggcuacaccuucaccgacuacuucauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34168 - RNA, 420 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaucuucaccggcagcuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcgccagcaccaagggccccagcguguucccccacgaccugaga

SEQ ID NO: 34169 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34170 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34171 - RNA, 420 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccggcuacuacauccacugggugagacaggcccccggccagggccuggaguggaugggcuggaucaaccccaacagcggcgccaccaacuacgcccagaaguuccagggcagacugaccaucgccagagacaccagcaucagcaccgccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguucccccacgaccugaga

SEQ ID NO: 34172 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguuccacgaccugaga

SEQ ID NO: 34173 - RNA, 414 nt, Artificial Sequence
  derived and/or modified sequence opt4 from anti-HIV-1_HeavyChain
caggccacccuggagcagagcggcagcggcgugaagaagcccggcgccagcgugagagugagcugcuggagcagcgaggacaucuucaagaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccacccacuucugcgccagacagaaguucgccagaggcgaccagggcugguucuucgaccuguggggcagaggcacccugaucguggugagcagcgccagcaccaagggccccagcguguuccccaccaucuacgug

SEQ ID NO: 34174 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguuccccaccaucugcgug

SEQ ID NO: 34175 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagccccagagcccacagaagcagccccagaagcgcc

SEQ ID NO: 34176 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguuccccaccaucugcgug

SEQ ID NO: 34177 - RNA, 414 nt, Artificial Sequence
  derived and/or modified sequence opt4 from anti-HIV-1_HeavyChain
caggcccaccuggagcagagcggccccggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagcgccagcaccaaggcccacagaagcagccccagaagcacc

SEQ ID NO: 34178 - RNA, 420 nt, Artificial Sequence
  derived and/or modified sequence opt4 from anti-HIV-1_HeavyChain
caggugcagcuggugcagagcggcgccgagaugaagaagcccggcgccagcgugaagcugagcugcaugaccagcggcuacguguucaccgacuucuacauccacugggugagacaggcccccggccagggccuggaguggaugggcuggaucaaccccggcaccggcggcaccaucagcgcccccagauuccugggcagagugacccugaccagagacaccagcaucagcgccgccuacaucgagaucaacagagugaccaucgacgacaccgccaccuacuucugcgccagacagaaguucgccagcagauacagcggcgaccagggcagcuacuucgaccuguggggcagaggcacccugaucguggugagcagcgccagcaccaagggcccccugggccugccccccagaagcgcc

SEQ ID NO: 34179 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggacccccgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagccccagagcccacagaagcagccccagaagcgcc

SEQ ID NO: 34180 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagcccgugaccggcgccgugaaccuggcccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34181 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34182 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaaggcccacagaagcagccccagaagcacc

SEQ ID NO: 34183 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguuccccaccaucugcgug

SEQ ID NO: 34184 - RNA, 414 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucaagaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34185 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguuccccaccaucuacgug

SEQ ID NO: 34186 - RNA, 417 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguuccccaccaucugcgug

SEQ ID NO: 34187 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccagaucuacgug

SEQ ID NO: 34188 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacagacccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguuccccaccaucuacgug

SEQ ID NO: 34189 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacaugggcaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguuccccaccaucuacgug

SEQ ID NO: 34190 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34191 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguuccccagaagcgccgug

SEQ ID NO: 34192 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcuggaugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34193 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucagcgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagcgccagcaccaagggccccagcguguuccccaccaucugcgug

SEQ ID NO: 34194 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34195 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguuccccaccaucuacgug

SEQ ID NO: 34196 - RNA, 417 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguuccccaccaucugcgug

SEQ ID NO: 34197 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaaccugggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34198 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgagagaggcggccagggcuggaucuucgaccuguggggcagaggcacccugaucgccgugagcagcgccagcaccaagggccccagcguguuccccaccaucugcgug

SEQ ID NO: 34199 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccuggug

SEQ ID NO: 34200 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguuccccaccaucuacgug

SEQ ID NO: 34201 - RNA, 420 nt, Artificial Sequence
  derived and/or modified sequence opt4 from anti-HIV-1_HeavyChain
caggugcaccuggagcagagcggcagcggcgugaagaagcccggcgcccccgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaaggcccacagcgugcugccccccagaagcagagug

SEQ ID NO: 34202 - RNA, 417 nt, Artificial Sequence
  derived and/or modified sequence opt4 from anti-HIV-1_HeavyChain
caggcccaccuggagcagagcggcagcggcgugaagaagcccggcgcccuggugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34203 - RNA, 414 nt, Artificial Sequence
  derived and/or modified sequence opt4 from anti-HIV-1_HeavyChain
caggugcagcuggugcagagcggcgccgaggugaagaagcccggcgccagcgugaaggugagcugccaggugagcggcuacacccugaccgagcugagcaugcacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34204 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34205 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguuccccaccaucugcgug

SEQ ID NO: 34206 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggagugggugggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34207 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguuccccaccaucugcgug

SEQ ID NO: 34208 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccagaucugcgug

SEQ ID NO: 34209 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggccaccagaucagcgacagagugagccugacccccgacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguuccccaccaucugcgug

SEQ ID NO: 34210 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagaagagcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaaggcccacagaagcagccccaccaucugcgug

SEQ ID NO: 34211 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgcccccaccaagggccccagcguguuccccaccaucugcgug

SEQ ID NO: 34212 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccagaucuacgug

SEQ ID NO: 34213 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagaggcagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguuccccaccaucugcgug

SEQ ID NO: 34214 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccacgug

SEQ ID NO: 34215 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccagaucugcgug

SEQ ID NO: 34216 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucguggugagcagcgccagcaccaagggccccagcguguuccccaccaucugcgug

SEQ ID NO: 34217 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcugggccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugcug

SEQ ID NO: 34218 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34219 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34220 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagcgccagcaccaagggccccagcguguuccccaccaucugcaga

SEQ ID NO: 34221 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34222 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguuccccaccaucuacgug

SEQ ID NO: 34223 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagcgccagcaccaagggccccagcguguucccccacgaccugaga

SEQ ID NO: 34224 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34225 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggcccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34226 - RNA, 417 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34227 - RNA, 417 nt, Artificial Sequence
  derived and/or modified sequence opt4 from anti-HIV-1_HeavyChain
caggcccaccuggagcagagcggcagcggcguggagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagcgccagcaccaagggccccagcguguucccccacgaccugaga

SEQ ID NO: 34228 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34229 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagaaaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34230 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34231 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuacggcagccugaacuucagaagcagaaucagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34232 - RNA, 417 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34233 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaucgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34234 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34235 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagagccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34236 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34237 - RNA, 417 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34238 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34239 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34240 - RNA, 417 nt, Artificial Sequence
  derived and/or modified sequence opt4 from anti-HIV-1_HeavyChain
caggcccaccuggagcagagcggcagcggcgugaagggccccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34241 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugccccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagcgccagcaccaagggccccagcguguucccccacgaccugaga

SEQ ID NO: 34242 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34243 - RNA, 417 nt, Artificial Sequence
  derived and/or modified sequence opt4 from anti-HIV-1_HeavyChain
caggcccaccuggagcagagcggcagcggcgugaagaaggugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34244 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34245 - RNA, 417 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34246 - RNA, 417 nt, Artificial Sequence
  derived and/or modified sequence opt4 from anti-HIV-1_HeavyChain
caggcccaccuggagcagagcgagagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34247 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguuccccaccacccugaga

SEQ ID NO: 34248 - RNA, 417 nt, Artificial Sequence
  derived and/or modified sequence opt4 from anti-HIV-1_HeavyChain
caggcccaccuggagcagagcggcagcggcgugaagaaggugggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34249 - RNA, 420 nt, Artificial Sequence
  derived and/or modified sequence opt4 from anti-HIV-1_HeavyChain
caggccagacccggcgccaacagaggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34250 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagcgccagcaccaagggccccagcguguucccccacgaccugaga

SEQ ID NO: 34251 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagcgccagcaccaagggccccagcguguucccccacgaccugaga

SEQ ID NO: 34252 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcgugcugccccccagaagcgcc

SEQ ID NO: 34253 - RNA, 417 nt, Artificial Sequence
  derived and/or modified sequence opt4 from anti-HIV-1_HeavyChain
caggcccaccuggagcagagcggcagcggcaugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34254 - RNA, 417 nt, Artificial Sequence
  derived and/or modified sequence opt4 from anti-HIV-1_HeavyChain
caggcccaccuggagcagagcggcagcggcgugaaggagcccggcaccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccagacccugaga

SEQ ID NO: 34255 - RNA, 417 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34256 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34257 - RNA, 417 nt, Artificial Sequence
  derived and/or modified sequence opt4 from anti-HIV-1_HeavyChain
caggcccaccuggagcagagcggcagcggcgugaagaaggugggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34258 - RNA, 417 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34259 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuacggcagccugaacuucagaagcagaaucagccugaccagagacagagaccuguucaccgcccacauggacaucagaggccugaccgagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34260 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugccuggccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34261 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34262 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34263 - RNA, 417 nt, Artificial Sequence
  derived and/or modified sequence opt4 from anti-HIV-1_HeavyChain
caggugcaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34264 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacagagagugagccugaccagagacagagaccuguucaccgcccacauggacaucagaggccugacccagggcgacaccgccaccuaccugugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34265 - RNA, 417 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagcgccagcaccaagggccccagcguguucccccacgaccugaga

SEQ ID NO: 34266 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugacccccgacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggcagcagcguguucccccacgaccugaga

SEQ ID NO: 34267 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugacccccgacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34268 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34269 - RNA, 417 nt, Artificial Sequence
  derived and/or modified sequence opt4 from anti-HIV-1_HeavyChain
caggugcaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacagaagcacc

SEQ ID NO: 34270 - RNA, 420 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguucaccaucuacgug

SEQ ID NO: 34271 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccccgcc

SEQ ID NO: 34272 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcgugcugccccccagaagcacc

SEQ ID NO: 34273 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34274 - RNA, 417 nt, Artificial Sequence
  derived and/or modified sequence opt4 from anti-HIV-1_HeavyChain
caggcccaccuggagcagagcggcagcgaguggaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34275 - RNA, 417 nt, Artificial Sequence
  derived and/or modified sequence opt4 from anti-HIV-1_HeavyChain
caggcccaccuggagcagagcggcagcgaggugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34276 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34277 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacauccugagaaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34278 - RNA, 417 nt, Artificial Sequence
  derived and/or modified sequence opt4 from anti-HIV-1_HeavyChain
caggcccaccuggagcagagcgccagcggcgugaagagacccggcgccagcgugagagugagcugccuggccagcgaggacaucuucgagagaagcgagcugaucuacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34279 - RNA, 417 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagcgccagcaccaagggccccagcguguucccccacgaccugaga

SEQ ID NO: 34280 - RNA, 417 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaagcgagcugaucuacugggugagacaggcccccggccagggccuggaguggaucggcugggugaagaccgugagcggcgccgugaacuucggcagcaccgacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34281 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcggccugccccccagaagcgcc

SEQ ID NO: 34282 - RNA, 417 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccugagaagcgcc

SEQ ID NO: 34283 - RNA, 423 nt, Artificial Sequence
  derived and/or modified sequence opt4 from anti-HIV-1_HeavyChain
caggugcagauggagcaggccggcgccggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagccagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcgccagcaccaagggccccagcguguucccccacgaccugaga

SEQ ID NO: 34284 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagcgccagcaccaagggccccagcguguucccccagaucugcaga

SEQ ID NO: 34285 - RNA, 414 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaaccuggugcaccagaucagcgacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34286 - RNA, 420 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcggccugccccccagacugugcgug

SEQ ID NO: 34287 - RNA, 417 nt, Artificial Sequence
  derived and/or modified sequence opt4 from anti-HIV-1_HeavyChain
caggccagacuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguucccccacgacagcgcc

SEQ ID NO: 34288 - RNA, 414 nt, Artificial Sequence
  derived and/or modified sequence opt4 from anti-HIV-1_HeavyChain
caggugcagcuggugcagagcggcgccgaggugaagaagcccggcagcagcgugaaggugagcugcaaggugagcggcggcguguucaccagcuacgccgugaccugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34289 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34290 - RNA, 417 nt, Artificial Sequence
  derived and/or modified sequence opt4 from anti-HIV-1_HeavyChain
cagagccaccuggagcagagcggcagcgccaugaagaagcccggcgccagcgugaccgugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcgacgaccugaga

SEQ ID NO: 34291 - RNA, 414 nt, Artificial Sequence
  derived and/or modified sequence opt4 from anti-HIV-1_HeavyChain
caggugcagcuggugcagagcggcgccgaggugaagaagcccggcgccagcgugaaggugagcugcaagagcagcggcuacagcuucaccagauucgacaucaccugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34292 - RNA, 420 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccaucggccugccccccagacugugcgug

SEQ ID NO: 34293 - RNA, 417 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34294 - RNA, 420 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcggccccagccccgagaucugcgug

SEQ ID NO: 34295 - RNA, 417 nt, Artificial Sequence
  derived and/or modified sequence opt4 from anti-HIV-1_HeavyChain
caggcccaccuggagcagagcggcgccggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34296 - RNA, 417 nt, Artificial Sequence
  derived and/or modified sequence opt4 from anti-HIV-1_HeavyChain
agagcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgccaacuacggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34297 - RNA, 417 nt, Artificial Sequence
  derived and/or modified sequence opt4 from anti-HIV-1_HeavyChain
caggugcaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34298 - RNA, 417 nt, Artificial Sequence
  derived and/or modified sequence opt4 from anti-HIV-1_HeavyChain
agagcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagccagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguuccccaccaucuacgug

SEQ ID NO: 34299 - RNA, 414 nt, Artificial Sequence
  derived and/or modified sequence opt4 from anti-HIV-1_HeavyChain
caggugcagcuggugcagagcgaggccgaggugaagaagcccggcgccagcgugaagaucagcugcgccaccagcggcuacgccuucacccuguacuaccugcacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagcgccagcaccaagggccccagcguguucccccacgaccugaga

SEQ ID NO: 34300 - RNA, 420 nt, Artificial Sequence
  derived and/or modified sequence opt4 from anti-HIV-1_HeavyChain
caggcccaccccgagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcggccugccccccagacugugcgug

SEQ ID NO: 34301 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccccagaagcacc

SEQ ID NO: 34302 - RNA, 417 nt, Artificial Sequence
  derived and/or modified sequence opt4 from anti-HIV-1_HeavyChain
caggcccaccuggagcagagcggcagcggcgugaagagacccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34303 - RNA, 417 nt, Artificial Sequence
  derived and/or modified sequence opt4 from anti-HIV-1_HeavyChain
ggcgcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34304 - RNA, 417 nt, Artificial Sequence
  derived and/or modified sequence opt4 from anti-HIV-1_HeavyChain
agacacgaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguucccccacgaccugaga

SEQ ID NO: 34305 - RNA, 420 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcgugaccaucuacgug

SEQ ID NO: 34306 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagccccggccccaucggccccagccccagaagcgcc

SEQ ID NO: 34307 - RNA, 417 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34308 - RNA, 417 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguuccccaccaucuacgug

SEQ ID NO: 34309 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggagagaaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguuccccaccaucugcgug

SEQ ID NO: 34310 - RNA, 420 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaacggccccaucggccccagccccaccgaccugaga

SEQ ID NO: 34311 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccagugggugagacaggcccccggccagggccuggaguggaugggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34312 - RNA, 417 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34313 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguuccccaccaucuacgug

SEQ ID NO: 34314 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccccaga

SEQ ID NO: 34315 - RNA, 423 nt, Artificial Sequence
  derived and/or modified sequence opt4 from anti-HIV-1_HeavyChain
cagguguacauggagcaggccggcgccggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcgccagcaccaagggccccagcguguucccccacgaccugaga

SEQ ID NO: 34316 - RNA, 423 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacaucuucgacgccgccuacaugcacugggugagacaggccagaggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcgccagcaccaagggccccagcguguuccccaccaucuacgug

SEQ ID NO: 34317 - RNA, 423 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguuccccaccaucuacgug

SEQ ID NO: 34318 - RNA, 423 nt, Artificial Sequence
  derived and/or modified sequence opt4 from anti-HIV-1_HeavyChain
cagguguacagcggcgccggcagaggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguuccccaccaucuacgug

SEQ ID NO: 34319 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccuucaccaagggccccagcguguucccccacgaccugaga

SEQ ID NO: 34320 - RNA, 414 nt, Artificial Sequence
  derived and/or modified sequence opt4 from anti-HIV-1_HeavyChain
caggugcagcugggccagagcggcgccgagaugaagaagcccggcagcagcgugaaggugagcugcaaggccagcggcggcaccuucagacacagccccaucagcugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34321 - RNA, 417 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34322 - RNA, 423 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcugggugaucgugagcagcgccagcaccaagggccccagcguguucccccacgaccugaga

SEQ ID NO: 34323 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguuccccaccaucugcgug

SEQ ID NO: 34324 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggcagaggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34325 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguuccccaccaucuacgug

SEQ ID NO: 34326 - RNA, 423 nt, Artificial Sequence
  derived and/or modified sequence opt4 from anti-HIV-1_HeavyChain
cagguguucauggagcaggccggcgccggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguucccccacgaccugaga

SEQ ID NO: 34327 - RNA, 423 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagacuggacgacaccgccguguacuucugcgccagaaagaccgccggcgacgugagcggcgacaagagaggcuucuucuucgaccuguggggcagaggcagcagagugaucgugagcagcgccagcaccaagggccccagcguguucccccacgaccugaga

SEQ ID NO: 34328 - RNA, 420 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguuccccaccauc

SEQ ID NO: 34329 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguuccccaccaucugcgug

SEQ ID NO: 34330 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagcgccagcaccaagggccccagcguguucccccacgaccugaga

SEQ ID NO: 34331 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34332 - RNA, 423 nt, Artificial Sequence
  derived and/or modified sequence opt4 from anti-HIV-1_HeavyChain
cagguguacaugggcgccggcagaggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguuccccaccaucuacgug

SEQ ID NO: 34333 - RNA, 423 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcgccagcaccaagggccccagcguguuccccaccaucugcgug

SEQ ID NO: 34334 - RNA, 423 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcgccagcaccaagggccccagcguguucccccacgaccugaga

SEQ ID NO: 34335 - RNA, 423 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcaaggugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguucccccacgaccugaga

SEQ ID NO: 34336 - RNA, 423 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagagcagagugagcuucuacggcaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguucccccacgaccugaga

SEQ ID NO: 34337 - RNA, 420 nt, Artificial Sequence
  derived and/or modified sequence opt4 from anti-HIV-1_HeavyChain
cagggccacaccguggagcagagcggcagcggcgugaagaagcugggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34338 - RNA, 420 nt, Artificial Sequence
  derived and/or modified sequence opt4 from anti-HIV-1_HeavyChain
caggccacccccuggagcaaccugggcagaggcgugaagaagcugggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagcgccagcaccaagggccccagcguguucccccacgaccugaga

SEQ ID NO: 34339 - RNA, 423 nt, Artificial Sequence
  derived and/or modified sequence opt4 from anti-HIV-1_HeavyChain
cagguguucauggagcaggccggcgccggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguucccccacgaccugaga

SEQ ID NO: 34340 - RNA, 423 nt, Artificial Sequence
  derived and/or modified sequence opt4 from anti-HIV-1_HeavyChain
cagguguacauggagcagagcggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguucccccacgaccugaga

SEQ ID NO: 34341 - RNA, 423 nt, Artificial Sequence
  derived and/or modified sequence opt4 from anti-HIV-1_HeavyChain
cagguguacauggagagaggcagaggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguucccccacgaccugaga

SEQ ID NO: 34342 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaagauuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguuccccaccaucugcgug

SEQ ID NO: 34343 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguucccccacgaccugaga

SEQ ID NO: 34344 - RNA, 423 nt, Artificial Sequence
  derived and/or modified sequence opt4 from anti-HIV-1_HeavyChain
cagguguucauggagcaggccggcggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcgccagcaccaagggccccagcguguucccccacgaccugaga

SEQ ID NO: 34345 - RNA, 423 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccug

SEQ ID NO: 34346 - RNA, 423 nt, Artificial Sequence
  derived and/or modified sequence opt4 from anti-HIV-1_HeavyChain
cagguguucauggagcaggccggcgccggcaugaagaagcccggcgccagcaugaccgugagcugcaagaccgccgacgaggacguguucgacgccgccuacaugcacugggugagacaggcccccggccccgaccuggaguggcugggcuggaugaagcccgugaccggcgccgugaacuacgccagaaaguuccagggcagagugagcuucuacagaaccagagagcugggcaucgccuacauggaccugagagaccugagauucgacgacaccgccguguacuucugcgccagaaagaccgccggcgacgugagcggcgacaagagaggcuucuucuucgaccuguggggcagaggcagcagagugaucgugagcagcgccagcaccaaggcccacagaagcagccccaccaucugcgug

SEQ ID NO: 34347 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34348 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucaacgacaccgccguguacuucugcgccagaaagaccgccggcgacgugagcggcgacaacagaggcuacuucuucgaccuguggggcagaggcagcagagugaucgugagcagcgccagcaccaagggccccagcguguucccccacgaccugaga

SEQ ID NO: 34349 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcggccugccccacgaccugaga

SEQ ID NO: 34350 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacggcaccgccguguacuucugcgccagaaagaccgccggcgacgugagcggcgacaagagaggcuucuucuucgaccuguggggcagaggcagcagagugaucgugagcagcgccagcaccaagggccccagcguguucccccacgaccugaga

SEQ ID NO: 34351 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguucccccacgaccugaga

SEQ ID NO: 34352 - RNA, 423 nt, Artificial Sequence
  derived and/or modified sequence opt4 from anti-HIV-1_HeavyChain
caggugcagcuggugcagagcggcgccgaggugaagaagcccggcgccagccugaaggugagcugcaaggccagcggcuacaccuucaccgacuacuacauccacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34353 - RNA, 423 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccugaucguggugagcagcgccagcaccagagcccacagaagcccccacgaccugaga

SEQ ID NO: 34354 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34355 - RNA, 426 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccagaucugcgug

SEQ ID NO: 34356 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcuggaugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaaggcccacagaagcagccccaccacccugaga

SEQ ID NO: 34357 - RNA, 423 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcguguuccccagaagcgcc

SEQ ID NO: 34358 - RNA, 423 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggccaccagaucagcgacagagugagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34359 - RNA, 423 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccagagcccacagaagcagccccagaagcgcc

SEQ ID NO: 34360 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34361 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguuccccaccaucuacgug

SEQ ID NO: 34362 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34363 - RNA, 423 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcguguuccccaccaucugc

SEQ ID NO: 34364 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgcccugcaccagggccccaucggccugccccccagaagcacc

SEQ ID NO: 34365 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcgugcugccccccagaagcgcc

SEQ ID NO: 34366 - RNA, 423 nt, Artificial Sequence
  derived and/or modified sequence opt4 from anti-HIV-1_HeavyChain
caggugcagcuggugcagagcggcgccgaggugaagaagcccggcgccagcgugaagaucagcugcaaggccagcggcuacaccuucaucagacacggcauccacuggcugagacaggugcccggccagagacccgaguggaugggcuggaucagacccaagaccggcgccagaaaccaggccagacaguuccagcccagaaucagccuggccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagcgcccugcaccagggccccaucggccugccccccagaagcacc

SEQ ID NO: 34367 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34368 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuaccugugcgccagacagaaguucgagagcagauacaccggcggccagggcugguacuucgaccuguggggcagaggcacccacaucguggugagcagcgccagcaccaagggccccagcguguuccccaccaucugcgug

SEQ ID NO: 34369 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccagaucugcgug

SEQ ID NO: 34370 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguuccccaccaucugcgug

SEQ ID NO: 34371 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagccuguacagcgacgaccagggcagcuacuucgaccuguggggcagaggcacccugaucaucgugagcagcgccagcaccaagggccccagcguguuccccaccaucugcgug

SEQ ID NO: 34372 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34373 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcguguuccccaccaucugcgug

SEQ ID NO: 34374 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguuccccaccaucugcgug

SEQ ID NO: 34375 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccacagaagcagccccaccaucugcgug

SEQ ID NO: 34376 - RNA, 423 nt, Artificial Sequence
  derived and/or modified sequence opt4 from anti-HIV-1_HeavyChain
cagguguacauggagcaggccggcgccggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguuccccaccaucuacgug

SEQ ID NO: 34377 - RNA, 423 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcuguacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34378 - RNA, 423 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcgccagcaccaagggccccagcguguucccccacgaccccgcc

SEQ ID NO: 34379 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguuccccaccaucugcgug

SEQ ID NO: 34380 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacagagagugagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguuccccaccaucugcgug

SEQ ID NO: 34381 - RNA, 426 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagagaaccgagcugaucuacugggugagacaggcccccggccagggccuggaguggaucggcugggugaagaccgugagcggcgccgugaacuucggcagccaggacuucagagacagauucagccugaccagagacagagaccuguucaccgcccacauggacaucagaggccugacccagggcgacaccgccaccuacuucugcgccagacagaaguucgccagcagauacagcggcgaccagggcagcuacuucgaccuguggggcagaggcacccugaucguggugagcagcgccagcaccaagggccccagcguguuccccaccaucugcgug

SEQ ID NO: 34382 - RNA, 426 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgagagcagauacaccggcggccagggcugguacuucgaccuguggggcagaggcacccacaucguggugagcagcgccagcaccaagggccccagcguguuccccaccaucugcgug

SEQ ID NO: 34383 - RNA, 423 nt, Artificial Sequence
  derived and/or modified sequence opt4 from anti-HIV-1_HeavyChain
caggugcacauggagcaggccggcggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuuccugcaggaccagggcaucagaaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcagccugcaccagggccccaucggccugccccccagaagcgcc

SEQ ID NO: 34384 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguuccccaccaucuacgug

SEQ ID NO: 34385 - RNA, 426 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaacuuccagggcagagugagcuucuacagaaccagagagcugggcaucgccuacauggaccugagaaaccugagauucgacgacaccgccguguacuucugcgccagaaagaccaagggcgacgugagcggcgacgacagaggcuucuucuucgaccuguggggcagaggcaccagagugaucgugagcagcggccugcaccagagagcccacagaagcagccccaccaucugcgug

SEQ ID NO: 34386 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguuccccaccaucugcgug

SEQ ID NO: 34387 - RNA, 423 nt, Artificial Sequence
  derived and/or modified sequence opt4 from anti-HIV-1_HeavyChain
cagguguacauggagcaggccggcgugggcgugaagaagcccggcgccagcgugacccugagcugcaagaccgccgacgaggacguguucgacgccgccuacaugcacugggugagacaggcccccggccccgaccuggaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagcgccagcaccaagggccccagcguguuccccaccaucugcgug

SEQ ID NO: 34388 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcguguucccccacgaccugaga

SEQ ID NO: 34389 - RNA, 426 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34390 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggagagaaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguuccccaccaucugcgug

SEQ ID NO: 34391 - RNA, 423 nt, Artificial Sequence
  derived and/or modified sequence opt4 from anti-HIV-1_HeavyChain
gagguguacauggagagaggcagaggcggcgugaagaagcccggcgccagcgccacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguucccccacgaccugaga

SEQ ID NO: 34392 - RNA, 426 nt, Artificial Sequence
  derived and/or modified sequence opt4 from anti-HIV-1_HeavyChain
caggcccaccuggagcagagcggcagcggcgugaagaagcccggcgccagcgccagagugagcugcuggagcagcgaggacaucuucgagagaaucgagcugauccacugggugagacaggcccccggccagggccuggaguggaucggcugggugaagaccguggccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34393 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugagacaggacgacaccgccaccuacuucugcgccagacagaaguucgagagcagauacagcggcgaccagggcagcuacuucgaccuguggggcagaggcacccugaucaucgugagcagcgccagcaccaagggccccagcguguuccccaccaucuacgug

SEQ ID NO: 34394 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacggcaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34395 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34396 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcggcgacauccugagaaagagcgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34397 - RNA, 426 nt, Artificial Sequence
  derived and/or modified sequence opt4 from anti-HIV-1_HeavyChain
caggugcaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccugcaccaagggccccagcguguucccccacgaccugaga

SEQ ID NO: 34398 - RNA, 426 nt, Artificial Sequence
  derived and/or modified sequence opt4 from anti-HIV-1_HeavyChain
caggcccaccuggagcagagcuggagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34399 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccccgaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 34400 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguuccccaccauccugaga

SEQ ID NO: 34401 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucgccgugagcagcgccagcaccaagggccccagcguguucccccacgaccugaga

SEQ ID NO: 34402 - RNA, 426 nt, Artificial Sequence
  derived and/or modified sequence opt4 from anti-HIV-1_HeavyChain
cagagccaccugaagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 34403 - RNA, 426 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucgagugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34404 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgagagcagauacagcggcgaccagggcagcuacuucgaccuguggggcagaggcacccugaucaucgugagcagcgccagcaccaagggccccagcguguucccccacgaccugaga

SEQ ID NO: 34405 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34406 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacagagagugagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcguguucccccacgaccugaga

SEQ ID NO: 34407 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 34408 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 34409 - RNA, 426 nt, Artificial Sequence
  derived and/or modified sequence opt4 from anti-HIV-1_HeavyChain
caggugcaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34410 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugagacaggacgacaccgccaccuacuucugcgccagacagaaguucgagagcagauacagcggcgaccagggcagcuacuucgaccuguggggcagaggcacccugaucaucgugagcagcgccagcaccaagggccccagcguguucccccacgaccugaga

SEQ ID NO: 34411 - RNA, 423 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcguggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguucccccacgaccugaga

SEQ ID NO: 34412 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagaaaccugagcaccgcccacauggacaucagaggccugagacaggacgacaccgccaccuacuucugcgccagacagaaguucgagagcagauacagcggcgaccagggcagcuacuucgaccuguggggcagaggcacccugaucaucgugagcagcgccagcaccaagggccccagcguguucccccacgaccugaga

SEQ ID NO: 34413 - RNA, 423 nt, Artificial Sequence
  derived and/or modified sequence opt4 from anti-HIV-1_HeavyChain
caggugcagcuggugcagagcggcgccgaggugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguuccccaccaucuacgug

SEQ ID NO: 34414 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcuggugcacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34415 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggcccccugggccugccccacgaccugaga

SEQ ID NO: 34416 - RNA, 426 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34417 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcguguucccccacgaccugaga

SEQ ID NO: 34418 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 34419 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 34420 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 34421 - RNA, 426 nt, Artificial Sequence
  derived and/or modified sequence opt4 from anti-HIV-1_HeavyChain
cagagccaccuggagcagagcggcagcgccaugaagaagcccggcgccagcgccagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccacaucguggugagcagcgccagcaccaagggccccagcguguucccccacgaccugaga

SEQ ID NO: 34422 - RNA, 426 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34423 - RNA, 426 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34424 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcguguucccccacgaccugaga

SEQ ID NO: 34425 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgccagaauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguuccccaccgaccugaga

SEQ ID NO: 34426 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34427 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaacggccccaucggccugccccacgaccugaga

SEQ ID NO: 34428 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34429 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34430 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccggccugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 34431 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccagaucuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34432 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34433 - RNA, 426 nt, Artificial Sequence
  derived and/or modified sequence opt4 from anti-HIV-1_HeavyChain
cagagccaccuggagcagagcggcagcgaggugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 34434 - RNA, 423 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagcgccagcaccaagggccccagcguguucccccacgaccugaga

SEQ ID NO: 34435 - RNA, 426 nt, Artificial Sequence
  derived and/or modified sequence opt4 from anti-HIV-1_HeavyChain
cagagccaccuggagcagagcggcagcgaggugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcguguucccccacgaccugaga

SEQ ID NO: 34436 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34437 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcgccaagggccccagcguguucccccacgaccugaga

SEQ ID NO: 34438 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgagagaaccgagcugaucuacugggugagacaggcccccggcagaggccuggaguggaucggcugggugaagaccgugagcggcaccgugaacuucggcagcagcgacuucagaaacagaaucagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucguggugagcagcgccagcaccaagggccccagcguguucccccccagaagcgcc

SEQ ID NO: 34439 - RNA, 426 nt, Artificial Sequence
  derived and/or modified sequence opt4 from anti-HIV-1_HeavyChain
caggugcacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccaagggcgacgugagcggcgacgacagaggcuucuucuucgaccuguggggcagaggcaccagagugaucgugagcagcgccagcaccaagggcccccugagaagcuuccccagaagaagcgcc

SEQ ID NO: 34440 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguuccccaccaucuacgug

SEQ ID NO: 34441 - RNA, 426 nt, Artificial Sequence
  derived and/or modified sequence opt4 from anti-HIV-1_HeavyChain
gagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcguguucccccacgaccugaga

SEQ ID NO: 34442 - RNA, 429 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcggccugccccccagaagcugcgug

SEQ ID NO: 34443 - RNA, 423 nt, Artificial Sequence
  derived and/or modified sequence opt4 from anti-HIV-1_HeavyChain
caggugcaccuggugcagagcggcgccgaggugaagaagcccggcgccagcgugaaggugagcugcaaggccagcggcuacaccuucaccaccagcggcauccacuggcugagacaggugcccggccagagacccgaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagcgccagcaccaagggccccagcguguucccccacgaccugaga

SEQ ID NO: 34444 - RNA, 429 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcacccagggccccaucggccugccccccagacugugcgug

SEQ ID NO: 34445 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccaucggccugccccccagaagcacc

SEQ ID NO: 34446 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguuccccaccaucugcgug

SEQ ID NO: 34447 - RNA, 426 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgcccugcaccagggccccaucggccugccccccagaagcacc

SEQ ID NO: 34448 - RNA, 429 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagagugagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgcccugcaccagggccccaucggccccagccccaccauccugaga

SEQ ID NO: 34449 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcguguuccccaccaucuacgug

SEQ ID NO: 34450 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgagagcagauacaccggcggccagggcugguacuucgaccuguggggcagaggcacccacaucguggugagcagcgccagcaccaagggccccagcguguuccccaccaucugcgug

SEQ ID NO: 34451 - RNA, 426 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgagagcagauacaccggcggccagggcugguacuucgaccuguggggcagaggcacccacaucguggugagcagcgccagcaccaagggccccagcguguuccccaccaucugcgug

SEQ ID NO: 34452 - RNA, 426 nt, Artificial Sequence
  derived and/or modified sequence opt4 from anti-HIV-1_HeavyChain
agaagacaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34453 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgagagcagauacagcggcgaccagggcagcuacuucgaccuguggggcagaggcacccugaucaucgugagcagcgccagcaccaagggccccagcguguuccccaccaucugcgug

SEQ ID NO: 34454 - RNA, 429 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggcccccaccccguguucccccacgaccugccc

SEQ ID NO: 34455 - RNA, 426 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguuccccaccaucuacgug

SEQ ID NO: 34456 - RNA, 429 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggccagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggcccccugggccugccccccagacugagcaga

SEQ ID NO: 34457 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagcgccagcaccaagggccccagcggccugccccccagaagcgcc

SEQ ID NO: 34458 - RNA, 426 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugagacaggacgacaccgccaccuacuucugcgccagacagaaguucgagagcagauacagcggcgaccagggcagcuacuucgaccuguggggcagaggcacccugaucaucgugagcagcgccagcaccaagggccccagcguguucccccacgaccugaga

SEQ ID NO: 34459 - RNA, 426 nt, Artificial Sequence
  derived and/or modified sequence opt4 from anti-HIV-1_HeavyChain
gaggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34460 - RNA, 423 nt, Artificial Sequence
  derived and/or modified sequence opt4 from anti-HIV-1_HeavyChain
caggugcagcuggugcagagcggcgccgaggugaagaagcccggcgccagcgugaaggugagcugcagagccagcggcuacaccuucggcaaccacgccaucagcugggugagacaggcccccggccagggccuggaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagcgccagcaccaagggccccagcguguucccccacgaccugaga

SEQ ID NO: 34461 - RNA, 429 nt, Artificial Sequence
  derived and/or modified sequence opt4 from anti-HIV-1_HeavyChain
cagggccacaaccuggagcagagcggcagcgaggugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguucccccacgaccugaga

SEQ ID NO: 34462 - RNA, 426 nt, Artificial Sequence
  derived and/or modified sequence opt4 from anti-HIV-1_HeavyChain
cccaccaccuggaacaagagcggcagcgacgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccugagcaccgcccacauggacaucagaggccugacccaggacgacaccgccaccuacuucugcgccagacagaaguucgagagccuguacagcgacgaccagggcagcuacuucgaccuguggggcagaggcacccugaucaucgugagcagcgccagcaccaagggccccagcguguucccccacgaccugaga

SEQ ID NO: 34463 - RNA, 432 nt, Artificial Sequence
  derived and/or modified sequence opt4 from anti-HIV-1_HeavyChain
cacgugacccccuggaacgaguacgugggcagagccaugaagaagcccggcagaagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguucccccacgaccugaga

SEQ ID NO: 34464 - RNA, 372 nt, Artificial Sequence
  derived and/or modified sequence opt4 from anti-HIV-1_HeavyChain
caggugcagcuggugcagagcggcgccgaggugagaagacccggcgccagcgugaaggugagcugcaaggccagcggcuucagcuuccugggccacuacauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 34465 - RNA, 372 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccagcuacggcaucagcugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 34466 - RNA, 372 nt, Artificial Sequence
  derived and/or modified sequence opt4 from anti-HIV-1_HeavyChain
caggugcagcuggugcagagcgaggccgaggugaagaagcccggcgccagcgugaagaucagcugcgccaccagcggcuacgccuucacccuguacuaccugcacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 34467 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 34468 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggcagaggccuggaguggaucggcugggugaaggccgugagcggcgccgugaacuacggcagccuggacuucagacacagagugccccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 34469 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggacccccgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 34470 - RNA, 375 nt, Artificial Sequence
  derived and/or modified sequence opt4 from anti-HIV-1_HeavyChain
caggcccaccuggagcagagcgccagcggcgugaagagacccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 34471 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 34472 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagagccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 34473 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 34474 - RNA, 375 nt, Artificial Sequence
  derived and/or modified sequence opt4 from anti-HIV-1_HeavyChain
caggugcaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 34475 - RNA, 375 nt, Artificial Sequence
  derived and/or modified sequence opt4 from anti-HIV-1_HeavyChain
caggccuaccuggagcagagcggcagcaucaugaagaagcccggcgccagcgugagagugagcugcuggaccagcgaggacaucuucgacagaaccgagcugaucuacugggugagacaggcccccggccagggccuggaguggaucggcugggugaagaucgugagcggcgccgugaacuucggcagccuggacuucagaaacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 34476 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugaucaacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 34477 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 34478 - RNA, 375 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 34479 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcggcgacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 34480 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacaccgacaucagaggccugacccagggcgacaccgccaccuacuucugcgccagacagaaguucgagagaggcggccagggcugguacuucgaccuguggggcagaggcacccugaucguggugagcagc

SEQ ID NO: 34481 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugccuggccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 34482 - RNA, 375 nt, Artificial Sequence
  derived and/or modified sequence opt4 from anti-HIV-1_HeavyChain
caggcccaccuggagcagagcggcgccggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggcagaggcacccugaucguggugagcagc

SEQ ID NO: 34483 - RNA, 375 nt, Artificial Sequence
  derived and/or modified sequence opt4 from anti-HIV-1_HeavyChain
agacacaccuggaacaagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagc

SEQ ID NO: 34484 - RNA, 375 nt, Artificial Sequence
  derived and/or modified sequence opt4 from anti-HIV-1_HeavyChain
ggcacccccggcagcgagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 34485 - RNA, 378 nt, Artificial Sequence
  derived and/or modified sequence opt4 from anti-HIV-1_HeavyChain
caggugcagcuggugcagagcggcaccgaggugcagaagcccggcgccagcgugaaggugagcugcaaggccuucggcuacagcuucaccgacuacuacguguacugggugagacaggcccccggccagggccuggaguacguggccuggaucaaccccagcaacggcuacaccaaguacgcccagaaguuccaggacugggugacccugaccagagacagcagcaucaacaccgccuaccugcagcuggccagagugaccagcgacgacaccgccaucuacuacugcgccagacagaaguucgccagcagauacagcggcgaccagggcagcuacuucgaccuguggggcagaggcacccugaucguggugagcagc

SEQ ID NO: 34486 - RNA, 378 nt, Artificial Sequence
  derived and/or modified sequence opt4 from anti-HIV-1_HeavyChain
caggugcagcuggugcagagcggcgccgccgugaagaagcccggcagcagcgugaaggugagcugcaaggccagcggcuacaucuucaccggcuacuacauccacuggaucagacaggcccccggccagggccuggaguggaugggcuggaucaaccccagcaccggcgacaccaaguucgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 34487 - RNA, 381 nt, Artificial Sequence
  derived and/or modified sequence opt4 from anti-HIV-1_HeavyChain
cagguguacauggagcaggccggcgccggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 34488 - RNA, 381 nt, Artificial Sequence
  derived and/or modified sequence opt4 from anti-HIV-1_HeavyChain
cagguguucauggagcaggccggcggcggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 34489 - RNA, 381 nt, Artificial Sequence
  derived and/or modified sequence opt4 from anti-HIV-1_HeavyChain
cagguguucauggagcaggccggcggcggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 34490 - RNA, 381 nt, Artificial Sequence
  derived and/or modified sequence opt4 from anti-HIV-1_HeavyChain
caggugcacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 34491 - RNA, 381 nt, Artificial Sequence
  derived and/or modified sequence opt4 from anti-HIV-1_HeavyChain
cagguguacauggagcaggccggcggcggcaugaagaagcccggcgccagcaugaccgugagcugcaagaccgccgacgaggacaucuucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagc

SEQ ID NO: 34492 - RNA, 381 nt, Artificial Sequence
  derived and/or modified sequence opt4 from anti-HIV-1_HeavyChain
cagguguacauggagcaggccggcggcggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcugggugaucgugagcagc

SEQ ID NO: 34493 - RNA, 381 nt, Artificial Sequence
  derived and/or modified sequence opt4 from anti-HIV-1_HeavyChain
caggugcagcuggugcagagcggcgccgaggugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugaacuacgccagaaaguuccagggcagagugagcuucuacagaaccagagagcugggcaucgccuacauggaccugagaaaccugagauucgacgacaccgccguguacuucugcgccagaaagaccgccggcgacgugagcggcgacaagagaggcuucuucuucgaccuguggggcagaggcagcagagugaucgugagcagc

SEQ ID NO: 34494 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagaggccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34495 - RNA, 384 nt, Artificial Sequence
  derived and/or modified sequence opt4 from anti-HIV-1_HeavyChain
caggcccaccuggagcagagcgccagcggcgugagaagacccggcgccagcgugagagugagcugcuggaccagcgaggacaucuucgagagaagcgagcugaucuacugggugagacaggcccccggcagaggccuggaguggaucggcuggaucaagcuggugagcggcgccgugaacuucggcagcguggacuucagagacagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34496 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuacggcagccugaacuucagaagcagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34497 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34498 - RNA, 384 nt, Artificial Sequence
  derived and/or modified sequence opt4 from anti-HIV-1_HeavyChain
caggugcaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34499 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugggcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34500 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34501 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgagggcaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34502 - RNA, 384 nt, Artificial Sequence
  derived and/or modified sequence opt4 from anti-HIV-1_HeavyChain
cagagcagacuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgcccacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34503 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34504 - RNA, 384 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagcagcgacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucaucgugagcagc

SEQ ID NO: 34505 - RNA, 384 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagc

SEQ ID NO: 34506 - RNA, 384 nt, Artificial Sequence
  derived and/or modified sequence opt4 from anti-HIV-1_HeavyChain
agacacaccugggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34507 - RNA, 384 nt, Artificial Sequence
  derived and/or modified sequence opt4 from anti-HIV-1_HeavyChain
agacacaccugggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34508 - RNA, 414 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaagcgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguacuacgccggcggccagggcugguacuucgaccuguggggcagaggcacccugaucguggugagcagcgccagcaccaagggccccagcguguuccacgaccugaga

SEQ ID NO: 34509 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagcgccagcaccaagggccccagcguguuccccaccaucugcgug

SEQ ID NO: 34510 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34511 - RNA, 417 nt, Artificial Sequence
  derived and/or modified sequence opt4 from anti-HIV-1_HeavyChain
caggcccaccuggagcagagcggcagcggcgugaagaaggugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaucuacuucugcgccagacagaaguucgccagaggcgaccagggcugguucuucgaccuguggggcagaggcacccugaucguggugagcagcgccagcaccaagggccccagcguguucccccacgaccugaga

SEQ ID NO: 34512 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34513 - RNA, 423 nt, Artificial Sequence
  derived and/or modified sequence opt4 from anti-HIV-1_HeavyChain
cagguguacauggagcaggccggcgccggcgugaagaagcccggcgccagcgugacccugagcugcaagaccgccgacgaggacguguucgacgccgccuacaugcacugggugagacaggcccccggccagaccuucgaguggcugggcuggaugaagcccgugaccggcgccgugagcuacgccagaaaguuccagggcagagugagcuucuacaugaccagagagcugggcauggccuacauggaccugagaaaccugagauucgacgacaccgccguguacuucugcgccagaaagaccgccggcgacgugagcggcgacaacagaggcuacuucuucgaccuguggggcagaggcagcagagugaucgugagcagcgccagcaccaagggccccagcguguucccccacgaccugaga

SEQ ID NO: 34514 - RNA, 426 nt, Artificial Sequence
  derived and/or modified sequence opt4 from anti-HIV-1_HeavyChain
cagagccaccuggagcagagcggcagcgccaugaagaagcccggcgccagcgugagagugagcugcuggaccagcgaggacaucuucgacaccaccgagcugaucuacugggugagacaggcccccggccagggccuggaguggaucggcugggugaagaucgugagcggcaccgugaacuucgccagccuggacuucagaaacagaaucagccugagcagagacagagaccugagcaccgccuacauggacaucagaggccugacccaggacgacaccgccaccuacuucugcgccagacagaaguucgccagcagauacagcggcgaccagggcagcuacuucgaccuguggggcagaggcacccugaucguggugagcagcgccagcaccaagggccccagcguguuccccaccaucuacgug

SEQ ID NO: 34515 - RNA, 372 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcggcacccugagcagcuacgccaucagcugggugagacaggcccccggccagggccuggaguggaucggcugggugaagaccgugaccggcgccgugaacuucggcagcgccugcuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 34516 - RNA, 372 nt, Artificial Sequence
  derived and/or modified sequence opt4 from anti-HIV-1_HeavyChain
cacgugagacuggugcagagcggcgccgagguggagaagcccggcgccagcgugaaggugagcugcgagaccagcaacuaccccuucaacauguacggcaugaccugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 34517 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacguguucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucuacgccggcggccagggcugguacuucgaccuguggggcagaggcacccugaucguggugagcagc

SEQ ID NO: 34518 - RNA, 375 nt, Artificial Sequence
  derived and/or modified sequence opt4 from anti-HIV-1_HeavyChain
agacacaccugggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 34519 - RNA, 375 nt, Artificial Sequence
  derived and/or modified sequence opt4 from anti-HIV-1_HeavyChain
agacacaccugggagcagagcggcagcggcgugaagagacccggcgccagcgugagagugagcugcuggaccagcgaggacaucuucgagaccaccgagcugauccacugggugagacaggcccccggccagggccuggaguggaucggcugggugaagaccgugagcggcgccgugaacuucggcagccugaacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 34520 - RNA, 381 nt, Artificial Sequence
  derived and/or modified sequence opt4 from anti-HIV-1_HeavyChain
cagguguucauggagcaggccggcgccggcaugaagaagcccggcgccagcaugaccgugagcugcaagaccgccgacgaggacguguucgacgccgccuacaugcacugggugagacaggcccccggccagaccuucgaguggcugggcuggaugaagcccgugaccggcgccgugaacuacgccagacaguuccagggcagagugagcuucuacagaaccagagagcugggcaucgccuacauggaccugagagaccugaaguucgacgacaccgccguguacuucugcgccagaaagaccaagggcgacgugagcggcgacgacagaggcuucuucuucgaccuguggggcagaggcaccagagugaucgugagcagc

SEQ ID NO: 34521 - RNA, 384 nt, Artificial Sequence
  derived and/or modified sequence opt4 from anti-HIV-1_HeavyChain
caggugcaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34522 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgccagcaccaagggccccagcguguuccccaccaucugcgug

SEQ ID NO: 34523 - RNA, 417 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucguggugagcagcgccagcaccaagggccccagcguguuccccaccaucugcgug

SEQ ID NO: 34524 - RNA, 417 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacguguucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucuacgccggcggccagggcugguacuucgaccuguggggcagaggcacccugaucguggugagcagcgccagcaccaagggccccagcguguucccccacgaccugaga

SEQ ID NO: 34525 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 34526 - RNA, 384 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagc

SEQ ID NO: 34527 - RNA, 426 nt, Artificial Sequence
  derived and/or modified sequence opt4 from anti-HIV-1_HeavyChain
caggcccaccuggagcagagcggcagcggcgugaagaagcccggcgccagcgugagagugagcugcuggagcagcgaggacaucuucgagagaaccgagcugauccacugggugagacaggcccccggccagggccuggaguggaucggcugggugaagaccgugaccggcgccgugaacuucggcagccuggacuucagacacagaaucagccugaccagagacagagaccuguucaccgcccacauggacaucagaggccugacccagggcgacaccgccaccuacuucugcgccagacagaaguucgagagcagauacaccggcggccagggcugguacuucgaccuguggggcagaggcacccacaucguggugagcagcgccagcaccaagggccccagcguguuccccaccaucugcgug

SEQ ID NO: 34528 - RNA, 375 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 34529 - RNA, 381 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuacaccaccuacggcgugagcuggcugagacaggugcccggccagagacccgaguggaugggcuggaucagacccaagaccggcgccagaaaccaggccagacaguuccagcccagaaucagccugaccagagacagagcccugagcaccgccuaccuggaccugaacagccugaccagcgccgacagcggcaccuacuucugcgccagacagaccuucaagcccgacuucuacuucgccgaccagggcuggagcuucaaccuguggggcagaggcgcccacuucaucgugagcagc

SEQ ID NO: 34530 - RNA, 384 nt, Artificial Sequence
  derived and/or modified sequence opt4 from anti-HIV-1_HeavyChain
agagcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgagagcagauacaccggcggccagggcugguacuucgaccuguggggcagaggcacccacaucaccgugagcagc

SEQ ID NO: 34531 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaucgugagcggcgccgugaacuucggcagccccaacuucagacagagagugagccugaccagagacagagaccuguucaccgcccacauggacaucagaggccugacccagggcgacaccgccaccuacuacugcgccagacagaaguucgagagaggcggccagggcuggaucuucgaccuguggggcagaggcacccugaucgccgugagcagc

SEQ ID NO: 34532 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuucugcgccagacagaaguucgccagaggcgaccagggcugguucuucgaccuguggggccacggcacccugaucguggugagcagc

SEQ ID NO: 34533 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggccacggcacccugaucguggugagcagc

SEQ ID NO: 34534 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacggcgaccuguucaccgcccacauggacaucagaggccugacccagggcgacaccgccaccuacuucugcgccagacagaaguucuacgccggcggccagggcugguacuucgaccuguggggcagaggcacccugaucaucgugagcagc

SEQ ID NO: 34535 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggccaccagaucagcgacagagugagccugaccagagacagagaccuguucaccgcccacauggacaucagaggccugacccagggcgacaccgccaccuacuucugcgccagacagaaguucuacgccggcggccagggcugguacuucgaccuguggggccacggcacccugaucguggugagcagc

SEQ ID NO: 34536 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggccacggcacccugaucguggugagcagc

SEQ ID NO: 34537 - RNA, 375 nt, Artificial Sequence
  derived and/or modified sequence opt4 from anti-HIV-1_HeavyChain
caggcccaccuggagcagagcggcgccggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuacugcgccagacagaaguucgagagaggcggccagggcugguacuucgaccuguggggcagaggcacccugaucguggugagcagc

SEQ ID NO: 34538 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggcagaggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuacugcgccagacagaaguucgagagaggcggccagggcuggaucuucgaccuguggggcagaggcacccugaucgccgugagcagc

SEQ ID NO: 34539 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuacugcgccagacagaaguucuacgccggcggccagggcugguacuucgaccuguggggcagaggcacccugaucguggugagcagc

SEQ ID NO: 34540 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 34541 - RNA, 372 nt, Artificial Sequence
  derived and/or modified sequence opt4 from anti-HIV-1_HeavyChain
uacguggagcugggcaccaacaccggccccgaggugagaaagcccggcgccagcgugaagaucagcugcaagaccagcggcuacaucuucaccgacaacuacuuccacuggcugagacaggcccccgccgugggccuggaguggaugggcuggaucaacagccacaacggcuacaccaagagcgccaagaaguuccagggcagaaucaccaugaccagagacaccgccguggacaccgccuacauggagcugaucgaccugaccagcgacgacaccgccaccuacuacugcgccagacagaaguucuacgccggcggccagggcugguacuucgaccuguggggcugcggcacccugaucguggugagcagc

SEQ ID NO: 34542 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggcagaggcacccugaucugcgugagcagc

SEQ ID NO: 34543 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuacugcgccagacagaaguucuacgccggcggccagggcugguacuucgaccuguggggcagaggcacccugaucguggugagcagc

SEQ ID NO: 34544 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagcccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucguggugagcagc

SEQ ID NO: 34545 - RNA, 375 nt, Artificial Sequence
  derived and/or modified sequence opt4 from anti-HIV-1_HeavyChain
caggugcagcuggugcagagcggcgccgaggugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuacugcgccagacagaaguucgagagaggcggccagggcugguacuucgaccuguggggcagaggcacccugaucguggugagcagc

SEQ ID NO: 34546 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacagcugcgccagacagaaguucgccagaggcgaccagggcugguucuucgaccuguggggcagaggcacccugaucguggugagcagc

SEQ ID NO: 34547 - RNA, 375 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuacugcgccagacagaaguucgagagaggcggccagggcugguacuucgaccuguggggcagaggcacccugaucguggugagcagc

SEQ ID NO: 34548 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcaccgugaacuucggcagccugaacuucagacagagagugagccugaccagagacagagaccuguucaccgcccacauggacaucagaggccugacccagggcgacaccgccaccuacuucugcgccagacagaaguucgccagaggcgaccagggcugguucuucgaccuguggggccacggcacccugaucguggugagcagc

SEQ ID NO: 34549 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccccuucaccgcccacauggacaucagaggccugacccagggcgacaccgccaccuacuucugcgccagacagaaguucgagagaggcggccagggcugguacuucgaccuguggggccacggcacccugaucguggugagcagc

SEQ ID NO: 34550 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucugcggccugacccagggcgacaccgccaccuacuucugcgccagacagaaguucgagagaggcggccagggcugguacuucgaccuguggggccacggcacccugaucguggugagcagc

SEQ ID NO: 34551 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacagagagugagccugaccagagacagagaccuguucaccgcccacauggacaucagaggccugacccagggcgacaccgccaccuacuacugcgccagacagaaguucuacgccggcggccagggcugguacuucgaccuguggggcagaggcacccugaucguggugagcagc

SEQ ID NO: 34552 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuucugcgccagacagaaguucuacgccggcggccagggcugguacuucgaccuguggggccacggcacccugaucguggugagcagc

SEQ ID NO: 34553 - RNA, 375 nt, Artificial Sequence
  derived and/or modified sequence opt4 from anti-HIV-1_HeavyChain
caggcccaccuggagcagagcggcagcggcgugaagaagcccggcaccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgccagaggcgaccagggcugguucuucgaccuguggggccacggcacccugaucguggugagcagc

SEQ ID NO: 34554 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuacugcgccagacagaaguucgccagaggcgaccagggcugguucuucgaccuguggggcagaggcacccugaucguggugagcagc

SEQ ID NO: 34555 - RNA, 381 nt, Artificial Sequence
  derived and/or modified sequence opt4 from anti-HIV-1_HeavyChain
caggugcagcuggugcagagcggcgccgaggugaagaagcccggcgccagcgugaaggugagcugcaaggccagcggcuacaccuucaccgacuacuaccugcacugggugagacaggcccccggccagggccuggacugggugggcuggaucaaccccaacagcggcggcaccaacuacgcccagaaguuccagggcagaguggccaugaccagagacaccagccugagcagcguguaccuggaccugaacagccugaccagcgccgacagcggcaccuacuucugcgccagacagaccuucaagcccgacuucuacuucgccgaccagggcuggagcuucaaccuguggggccagggcagccacuucaucgugagcagc

SEQ ID NO: 34556 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagaagagcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuacugcgccagacagaaguucuacgccggcggccagggcugguacuucgaccuguggggcagaggcacccugaucguggugagcagc

SEQ ID NO: 34557 - RNA, 372 nt, Artificial Sequence
  derived and/or modified sequence opt4 from anti-HIV-1_HeavyChain
caggcccaccuggagcagagcggcagcggcgugaagaagcccggcgccagcgugaccgugagcugcuggaccagcgaggacaucuucgagaagagcgagcugauccacugggugagacaggcccccggccagggccuggaguggaucggcugggugaagaccgugaccggcgccgugaaccugguguaccagaucagcgacagagugagccugaccagagacagaggccuguucaccgcccacauggacaucagaggccugacccagggcgacaccgccaccuacuacugcgccagacagaaguucuacgccggcggccagggcugguacuucgaccuguggggcagaggcacccugaucguggugagcagc

SEQ ID NO: 34558 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagggcagcgagcugauccacugggugagacaggcccccggccagggccuggaguggaucggcugggugaagaccgugaccggcgccgugaacuucggcagcgccuacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggccacggcacccugaucguggugagcagc

SEQ ID NO: 34559 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuacggcagccugaacuucagaagcagaaucagccugaccagagacagagaccuguucaccgcccacauggacaucagaggccugaccgagggcgacaccgccaccuacuucugcgccagacagaaguucuacgccggcggccagggcugguacuucgaccuguggggccacggcacccugaucguggugagcagc

SEQ ID NO: 34560 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacauggccaccuacuucugcgccagacagaaguucgagagaggcggccagggcugguacuucgaccuguggggccacggcacccugaucguggugagcagc

SEQ ID NO: 34561 - RNA, 375 nt, Artificial Sequence
  derived and/or modified sequence opt4 from anti-HIV-1_HeavyChain
caggcccaccuggagcagagcggcagcggcgugaaggagcccggcaccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcuggaucuucgaccuguggggcagaggcacccugaucgccgugagcagc

SEQ ID NO: 34562 - RNA, 375 nt, Artificial Sequence
  derived and/or modified sequence opt4 from anti-HIV-1_HeavyChain
caggugcagcuggagcagagcggcagcggcgugaagaagcugggcgccagcgugagagugagcugcuggaccagcgaggacaucuucggcagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccaggacgacaccgccaccuacuacugcgccagacagaaguucgccagaggcgaccagggcugguucuucgaccuguggggcagaggcacccugaucguggugagcagc

SEQ ID NO: 34563 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgacgacaucuucaagaccgagcugauccacugggugagacaggcccccggccagggccuggaguggaucggcugggugaagaccgugaccggcgccgugaacuucggcagccccaacuucagacagagagugagccugaccagagacagagaccuguucaccgcccacauggacaucagaggccugacccaggacgacaccgccaccuacuucugcgccagacagaaguucgccagaggcgaccagggcugguucuucgaccuguggggcagaggcacccugaucguggugagcagc

SEQ ID NO: 34564 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagagaaccgagcugauccacugggugagacaggcccccggccagggccuggaguggaucggcugggugaagaccgugaccggcgccgugaacuucggcagccccaacuucagacacagagugagccugaccagagacagagaccuguucaccgcccacauggacaucagaggccugacccagggcgacaccgccaccuacuacugcgugagacagaaguucgagagaggcggccagggcugguacuucgaccuguggggcagaggcacccugaucguggugagcagc

SEQ ID NO: 34565 - RNA, 375 nt, Artificial Sequence
  derived and/or modified sequence opt4 from anti-HIV-1_HeavyChain
caggugcagcuggugcagagcggcgccgaggugaagaagcccggcgccagcgugaaggugagcugcuggaccagcgaggacaucuucgagaagagcgagcugauccacugggugagacaggcccccggccagggccuggaguggaucggcugggugaagaccgugaccggcgccgugaacuucggcagcagcgacuucagacagagagugagccugaccagagacagagaccuguucaccgcccacauggacaucagaggccugacccagggcgacaccgccaccuacuacugcgccagacagaaguucuacgccggcggccagggcugguacuucgaccuguggggcagaggcacccugaucguggugagcagc

SEQ ID NO: 34566 - RNA, 375 nt, Artificial Sequence
  derived and/or modified sequence opt4 from anti-HIV-1_HeavyChain
caggcccaccuggagcagagcggcagcggcgugaagaagcugggcgccagcgugagagugagcugcuggaccagcgaggacaucuucgagagaaccgagcugauccacugggugagacaggcccccggccagggccuggaguggaucggcugggugaaggccgugagcggcgccgugaacuacggcagccuggacuucagacacagagugagccugaccagagacagagaccuguucaccgcccacauggacaucagaggccugacccagggcgacaccgccaccuacuucugcgccagacagaaguucuacaagggcggccagggcugguacuucgaccuguggggcagaggcacccugaucguggugagcagc

SEQ ID NO: 34567 - RNA, 372 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucgagaagagcgagcugauccacugggugagacaggcccccggccagggccuggaguggaucggcugggugaagaccgugaccggcgccgugaacuucgcccaccagaucagcgacagagugagccugaccagagacagagaccuguucaccgcccacauggacaucagaggccugacccagggcgacaccgccaccuacuacugcgccagacagaaguucuacgccggcggccagggcugguacuucgaccuguggggcagaggcacccugaucguggugagcagc

SEQ ID NO: 34568 - RNA, 375 nt, Artificial Sequence
  derived and/or modified sequence opt4 from anti-HIV-1_HeavyChain
caggcccaccuggagcagagcggcagcggcgugaagaagcccggcgccagcgugagagugagcugcuggaccagcgaggacaucuucggcagaaccgagcugauccacugggugagacaggcccccggccagggccuggaguggaucggcugggugaagaccgugagcggcgccgugaacuucggcagccccaacuucagacacagagugagccugaccagagacagagaccuguucaccgcccacauggacaucagaggccugacccagggcgacaccgccaccuacuucugcgccagacagaaguucgagagaggcggccagggcugguacuucgaccuguggggcagaggcacccugaucugcgugagcagc

SEQ ID NO: 34569 - RNA, 636 nt, Artificial Sequence
  derived and/or modified sequence opt4 from anti-HIV_5CIN_LightChain
gagaucgugcugacccagagccccggcacccagagccugagccccggcgagagagccacccugagcugcagagccagccagagcgugggcaacaacaagcuggccugguaccagcagagacccggccaggcccccagacugcugaucuacggcgccagcagcagacccagcggcguggccgacagauucagcggcagcggcagcggcaccgacuucacccugaccaucagcagacuggagcccgaggacuucgccguguacuacugccagcaguacggccagagccugagcaccuucggccagggcaccaagguggaggugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacaga

SEQ ID NO: 34570 - RNA, 672 nt, Artificial Sequence
  derived and/or modified sequence opt4 from anti-HIV_5CIN_HeavyChain
gugcagcuggugcagagcggcgccgaggugaagagacccggcagcagcgugaccgugagcugcaaggccagcggcggcagcuucagcaccuacgcccugagcugggugagacaggcccccggcagaggccuggaguggaugggcggcgugaucccccugcugaccaucaccaacuacgcccccagauuccagggcagaaucaccaucaccgccgacagaagcaccagcaccgccuaccuggagcugaacagccugagacccgaggacaccgccguguacuacugcgccagagagggcaccaccggcagcggcggcaagcccaucggcgccuucgcccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagccc

SEQ ID NO: 34571 - RNA, 678 nt, Artificial Sequence
  derived and/or modified sequence opt4 from anti-HIV_5CIL_HeavyChain
gugcagcuggugcagagcggcgccgaggugaagagacccggcagcagcgugaccgugagcugcaaggccagcggcggcagcuucagcaccuacgcccugagcugggugagacaggcccccggcagaggccuggaguggaugggcggcgugaucccccugcugaccaucaccaacuacgcccccagauuccagggcagaaucaccaucaccgccgacagaagcaccagcaccgccuaccuggagcugaacagccugagacccgaggacaccgccguguacuacugcgccagagagggcaccaccggcgacggcgaccugggcaagcccaucggcgccuucgcccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagccc

SEQ ID NO: 34572 - RNA, 678 nt, Artificial Sequence
  derived and/or modified sequence opt4 from anti-HIV_5CIP_A-Chain
gugcagcuggugcagagcggcgccgaggugaagagacccggcagcagcgugaccgugagcugcaaggccagcggcggcagcuucagcaccuacgcccugagcugggugagacaggcccccggcagaggccuggaguggaugggcggcgugaucccccugcugaccaucaccaacuacgcccccagauuccagggcagaaucaccaucaccgccgacagaagcaccagcaccgccuaccuggagcugaacagccugagacccgaggacaccgccguguacuacugcgccagagagggcaccaccggcuggggcuggcugggcaagcccaucggcgccuucgcccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagccc

SEQ ID NO: 34573 - RNA, 681 nt, Artificial Sequence
  derived and/or modified sequence opt4 from anti-HIV_5CIP_HeavyChain
gugcagcuggugcagagcggcgccgaggugaagagacccggcagcagcgugaccgugagcugcaaggccagcggcggcagcuucagcaccuacgcccugagcugggugagacaggcccccggcagaggccuggaguggaugggcggcgugaucccccugcugaccaucaccaacuacgcccccagauuccagggcagaaucaccaucaccgccgacagaagcaccagcaccgccuaccuggagcugaacagccugagacccgaggacaccgccguguacuacugcgccagagagggcaccaccggcuggggcuggcugggcaagcccaucggcgccuucgcccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaag

SEQ ID NO: 34574 - RNA, 630 nt, Artificial Sequence
  derived and/or modified sequence opt4 from anti-HIV_4JKP_LightChain
gagaucgugcugacccagagccccgccacccugagccugagccccggcgagaccgccaucaucagcugcagaaccagccaguacggcagccuggccugguaccagcagagacccggccaggcccccagacuggugaucuacagcggcagcaccagagccgccggcauccccgacagauucagcggcagcagauggggcgccgacuacaaccugagcaucagcaaccuggagagcggcgacuucggcguguacuacugccagcaguacgaguucuucggccagggcaccaaggugcagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 34575 - RNA, 678 nt, Artificial Sequence
  derived and/or modified sequence opt4 from anti-HIV_3TNN_E-Chain
gaggugcagcugguggagagcggcggcggccuggugcagcccggcggcagccugagacugagcugcgccgccagcggcuucaccuucagcaccuacgccaugagcugggugagacaggcccccggcaagggccuggagugggugagcagcaucaacaacagcggcagaaacaccuucagcgccgacagcgugaagggcagauucaccaucagcagagacaacagcaagaacacccuguuccuggugaugaacagccugagagccgaggacaccgccguguacuacugcgccaaggaccugagacugggcggcggcagcgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccac

SEQ ID NO: 34576 - RNA, 705 nt, Artificial Sequence
  derived and/or modified sequence opt4 from anti-HIV_3BQU_B-Chain
agaaucacccugaaggagagcggccccccccuggugaagcccacccagacccugacccugaccugcagcuucagcggcuucagccugagcgacuucggcgugggcgugggcuggaucagacagccccccggcaaggcccuggaguggcuggccaucaucuacagcgacgacgacaagagauacagccccagccugaacaccagacugaccaucaccaaggacaccagcaagaaccagguggugcuggugaugaccagagugagccccguggacaccgccaccuacuucugcgcccacagaagaggccccaccacccuguucggcgugcccaucgccagaggccccgugaacgccauggacguguggggccagggcaucaccgugaccaucagcagcaccagcaccaagggccccagcguguucccccuggcccccagcagcaagagcaccgccggcggcgccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaccugcaacgugaaccacaagcccagcaacaccaagguggacaagagaguggagcccaagagcugc

SEQ ID NO: 34577 - RNA, 642 nt, Artificial Sequence
  derived and/or modified sequence opt4 from anti-HIV_3BQU_A-Chain
gcccugcagcugacccagagccccagcagccugagcgccagcgugggcgacagaaucaccaucaccugcagagccagccagggcgugaccagcgcccuggccugguacagacagaagcccggcagccccccccagcugcugaucuacgacgccagcagccuggagagcggcgugcccagcagauucagcggcagcggcagcggcaccgaguucacccugaccaucagcacccugagacccgaggacuucgccaccuacuacugccagcagcugcacuucuacccccacaccuucggcggcggcaccagaguggacgugagaagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgagugcgaggugacccaccagggccugagcagccccgugaccaagagcuucaacagaggcgagugc

SEQ ID NO: 34578 - RNA, 387 nt, Artificial Sequence
  derived and/or modified sequence opt4 from anti-HIV_IgG_VR-Chain
auggagacccccgcccagcugcuguuccugcugcugcuguggcugcccgacaccaccggcgagaucgugcugacccagagccccggcacccugagccugagcgccggcgagagagccacccugagcugcagagccagccagagcgugagcagcagauaccuggccugguaccagcagaagcccggccaggcccccagacugcugaucuacggcgccagcagcagagccaccggcauccccgacagauucagcggcagcggcagcggcaccgacuucacccugaccaucagcagaguggagcccgaggacuucgccggcuacuacugccagcaguacgacaacagcgugugcaccuucggccagggcaccaagcuggagaucaagaga

SEQ ID NO: 34579 - RNA, 348 nt, Artificial Sequence
  derived and/or modified sequence opt4 from anti-HIV_IgG_HeavyChain
augaagcaccugugguucuuccugcugcugguggccgcccccagaugggugcugagccaggugcagcugcaggagagcggccccggccuggugaagcccagcgagacccugagccugaccugcaccgugagcggcggcagcaucagcagccacuacuggagcuggaucagacagagccccggcaagggccugcaguggaucggcuacaucuacuacagcggcagcaccaacuacagccccagccugaagagcagagugaccaucagcguggagaccagcaagaaccaguucagccugaagcugaccagcaugaccgccgccgacaccgccguguacuacugcgccaga

SEQ ID NO: 34580 - RNA, 714 nt, Artificial Sequence
  derived and/or modified sequence opt4 from anti-HIV_4P9M_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagaaccugaccagcgacgacaccgccguguacuucugcaccaccaccagcaccuacgacaaguggagcggccugcaccacgacggcgugauggccuucagcagcuggggccagggcacccugaucagcgugagcgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacc

SEQ ID NO: 34581 - RNA, 645 nt, Artificial Sequence
  derived and/or modified sequence opt4 from anti-HIV_4P9M_LightChain
gacauccagaugacccagagccccagcacccugagcgccagcaucggcgacaccgugagaaucagcugcagagccagccagagcaucaccggcaacuggguggccugguaccagcagagacccggcaaggcccccagacugcugaucuacagaggcgccgcccugcugggcggcgugcccagcagauucagcggcagcgccgccggcaccgacuucacccugaccaucggcaaccugcaggccgaggacuucggcaccuucuacugccagcaguacgacaccuaccccggcaccuucggccagggcaccaagguggaggugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 34582 - RNA, 558 nt, Artificial Sequence
  derived and/or modified sequence opt4 from anti-HIV_4P9H_C-Chain
aagaagguggugcugggcaagaagggcgacaccguggagcugaccugcaccgccagccagaagaagagcauccaguuccacuggaagaacagcaaccagaucaagauccugggcaaccagggcagcuuccugaccaagggccccagcaagcugaacgacagagccgacagcagaagaagccugugggaccagggcaacuucccccugaucaucaagaaccugaccaucgaggacagcgacaccuacaucugcgagguggaggaccagaaggaggaggugcagcugcugguguucggccugaccgccaacagcgacacccaccugcugcagggccagagccugacccugacccuggagagcccccccggcagcagccccagcgugcagugcagaagccccagaggcaagaacauccagggcggcaagacccugagcgugagccagcuggagcugcaggacagcggcaccuggaccugcaccgugcugcagaaccagaagaagguggaguucaagaucgacaucguggugcuggccuuccagaaggccaucgacggcaga

SEQ ID NO: 34583 - RNA, 462 nt, Artificial Sequence
  derived and/or modified sequence opt4 from anti-HIV_4YBL_A-Chain
gugcccguguggaaggacgccgacaccacccuguucugcgccagcgacgccaaggcccacgagaccgagugccacaacgugugggccacccacgccugcgugcccaccgaccccaacccccaggagauccaccuggagaacgugaccgagaacuucaacauguggaagaacaacaugguggagcagaugcaggaggacgugaucagccugugggaccagugccugcagcccggcggcgcccccaagaucagcuucgaccccauccccauccacuacugcacccccgccggcuacgugauccugaagugcaacgacaagaacuucaacggcaccggccccugcaagaacgugagcagcgugcagugcacccacggcaucaagcccguggugagcagcggcggcggcaacaucaaggacaacuggagaagcgagcuguacaaguacaagguggugcagaucgag

SEQ ID NO: 34584 - RNA, 1056 nt, Artificial Sequence
  derived and/or modified sequence opt4 from anti-HIV_4R4N_V-Chain
aucuggaaggacgccaacaccacccuguucugcgccagcgacgccaaggccuacgacaccgaggugcacaacgugugggccacccacgccugcgugcccaccgaccccagcccccaggagcugaagauggagaacgugaccgaggaguucaacauguggaagaacaacaugguggagcagaugcacaccgacaucaucagccugugggaccagagccugaagcccugcgugcagcugaccggcggcagcgcccugacccaggccugccccaaggugaccuucgagcccauccccauccacuacugcgcccccgccggcuacgccauccugaagugcaacgacaaggaguucaacggcaccggccugugcaagaacgugagcaccgugcagugcacccacggcaucagacccguggugagcacccagcugcugcugaacggcagccuggccgagggcaaggugaugaucagaagcgagaacaucaccaacaacgugaagaacaucaucgugcagcugaacgagagcgugaccaucaacugcaccagacccaacaacggcggcagcggcagcggcggcgacaucagacaggcccacugcaacgugagcggcagccaguggaacaagacccugcaccaggugguggagcagcugagaaaguacuggaacaacaacaccaucaucuucaacagcagcagcggcggcgaccuggagaucaccacccacagcuucaacugcggcggcgaguucuucuacugcaacaccagcggccuguucaacagcaccugggugaacggcaccgccagcaucgagaacggcaccaucacccugcccugcagaaucaagcagaucaucaacauguggcagagagugggccaggccaucuacgccccccccauccagggcgugaucagaugcgugagcaacaucaccggccugauccugaccagagacggcggcggcaacagcaacgagaacgagaccuucagacccggcggcggcgacaugagagacaacuggagaagcgagcuguacaaguacaagguggugaagaucgag

SEQ ID NO: 34585 - RNA, 1065 nt, Artificial Sequence
  derived and/or modified sequence opt4 from anti-HIV_4JKP_G-Chain
guguggaaggacgccgacaccacccuguucugcgccagcgacgccaaggcccacgagaccgagugccacaacgugugggccacccacgccugcgugcccaccgaccccaacccccaggagauccaccuggagaacgugaccgagaacuucaacauguggaagaacaacaugguggagcagaugcaggaggacgugaucagccugugggaccagugccugcagcccugcgugaagcugaccggcggcagcgugaucaagcaggccugccccaagaucagcuucgaccccauccccauccacuacugcacccccgccggcuacgugauccugaagugcaacgacaagaacuucaacggcaccggccccugcaagaacgugagcagcgugcagugcacccacggcaucaagcccguggugagcacccagcugcugcugaacggcagccuggccgaggaggagaucaucaucagaagcgagaaccugaccaacaacgccaagaccaucaucgugcaccugaacaagagcguggagaucaacugcaccagacccagcaacggcggcagcggcagcggcggcgacaucagaaaggccuacugcgagaucaacggcaccaaguggaacaaggugcugaagcaggugaccgagaagcugaaggagcacuucaacaacaagaccaucaucuuccagccccccagcggcggcgaccuggagaucaccaugcaccacuucaacugcagaggcgaguucuucuacugcaacaccacccagcuguucaacaacaccugcaucggcaacgagaccaugaagggcugcaacggcaccaucacccugcccugcaagaucaagcagaucaucaacauguggcagggcaccggccaggccauguacgccccccccaucgacggcaagaucaacugcgugagcaacaucaccggcauccugcugaccagagacggcggcgccaacaacaccagcaacgagaccuucagacccggcggcggcaacaucaaggacaacuggagaagcgagcuguacaaguacaagguggugcagaucgagggcagc

SEQ ID NO: 34586 - RNA, 723 nt, Artificial Sequence
  derived and/or modified sequence opt4 from anti-HIV_3BQU_D-Chain
augggcuggagcuggaucuuccuguuccugcugagcggcaccgccggcgugcacagcggcgugcagcugcagcagagcggccccgagcuggugaagcccggcgccagcgugaagaugagcugcaaggccagcggcuacagcuucaccgacuacuucaugcacugggugaagcagagccacggcaagagccuggacuggaucggcuacaucaacugcuacaccggcgccaccaacuacagccagaaguucaagggcaaggccaccuucaccguggacaccagcagcaacaccgccuacaugcaguucaacagccugaccagcgaggacagcgccguguacuacugcgccagaaccagcaucggcuacggcagcagcccccccuuccccuacuggggccagggcacccuggugaccgugagcgccgccaagaccaccccccccagcguguacccccuggcccccggcagcgccgcccagaccaacagcauggugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagccccagacccagcgagaccgugaccugcaacguggcccaccccgccagcagcaccaagguggacaagaagaucgugcccaga

SEQ ID NO: 34587 - RNA, 699 nt, Artificial Sequence
  derived and/or modified sequence opt4 from anti-HIV_3BQU_C-Chain
augaccauguucagccuggcccugcugcugagccugcugcugcugugcgugagcgacagcggcgccgagaccaccgugacccagagccccgccagccugagcaugagcaucggcgagaaggugaccaucagaugcaucaccagcaccgacaucgacgacgacaugaacugguaccagcagaagcccggcgagccccccagacugcugaucagcgacggcaacacccugagacccggcgugcccagcagauucagcagcagcggcuacggcaccgacuucguguucaccaucgagaacaugcugagcgaggacguggccgacuacuacugccugcagagcgacaaccugcccuacaccuucggcggcggcaccaaccuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacaga

SEQ ID NO: 34588 - RNA, 333 nt, Artificial Sequence
  derived and/or modified sequence opt4 from anti-HIV_Ig_LightChain
gacguggugcugacccagagccccgccagccuggccgugagccugggccagagagccaccaucagcugcaaggccagccagagcguggacuacgacggcgacagcuacaugaacugguaccagcagaagcccggccagccccccaagcugcugauccacgccgccagcaaccuggugagcggcaugcccgccagauucagcggcagcggcagcggcaccgacuucacccugaacauccaccccguggaggaggaggacgccgccaccuacuacugccagcagagcaucgaggacccccccaccuucggcggcggcaccaagcuggagaucaag

SEQ ID NO: 34589 - RNA, 342 nt, Artificial Sequence
  derived and/or modified sequence opt4 from anti-HIV_Ig_HeavyChain
gacgugcagcugcagcagagcggccccggccuggugaagcccagccagagccugagccacaccugcaccgugaccggcuacagcaucaccagcgacuacgccuggaacuggaucagacaguuccccggcaacaagcuggaguggaugggcuacaucagcuucagcggcagcaccagcuacaaccccagccugaagagcagaaucagcaucaccagagacaccagcaagaaccuguucuuccugcagcugaacagcgugaccaccgaggacaccgccaccuacuacugcgccagaggccugcccgacuacuggggccagggcaccacccugaccgugagcagc

SEQ ID NO: 34590 - RNA, 1083 nt, Artificial Sequence
  derived and/or modified sequence opt4 from anti-HIV_4P9H_G-Chain
guguggaaggacgccgacaccacccuguucugcgccagcgacgccaaggcccacgagaccgagugccacaacgugugggccacccacgccugcgugcccaccgaccccaacccccaggagauccaccuggagcaggugaccgagaacuucaacauguggaagaacaacaugguggagcagaugcaggaggacgugaucagccugugggaccagugccugcagcccugcgugaagcugaccggcggcagcgugaucaagcaggccugccccaagaucagcuucgaccccauccccauccacuacugcacccccgccggcuacgugauccugaagugcaacgacaagaacuucaacggcaccggccccugcaagaacgugagcagcgugcagugcacccacggcaucaagcccguggugagcacccagcugcugcugaacggcagccuggccgaggaggagaucaucaucagaagcgagaaccugaccaacaacgccaagaccaucaucgugcaccugcagaagagcguggagaucaacugcaccagacccagcaacggcggcagcggcagcggcggcgacaucagaaaggccuacugcgagauccagggcaccaaguggaacaaggugcugaagcaggugaccgagaagcugaaggagcacuucaacaacaagaccaucaucuuccagccccccagcggcggcgaccuggagaucaccaugcaccacuucaacugcagaggcgaguucuucuacugcaacaccacccagcuguuccagaacaccugcaucggcaacgagaccaugaagggcugcaacggcaccaucacccugcccugcaagaucaagcagaucaucaacauguggcagggcaccggccaggccauguacgccccccccaucgacggcaagaucaacugcgugagccagaucaccggcauccugcugaccagagacggcggcgccaacaacaccagcaacgagaccuucagacccggcggcggcaacaucaaggacaacuggagaagcgagcuguacaaguacaagguggugcagaucgagggcagccaccaccaccaccaccac

SEQ ID NO: 34591 - RNA, 147 nt, Artificial Sequence
  derived and/or modified sequence opt4 from anti-HIV_Chain
caggugcagcuggugcagagcggcggccagaugaagaagcccggcgagagcaugagaaucagcugcagagccagcggcuacgaguucaucgacugcacccugaacuggaucagacuggcccccggcaagagacccgaguggaugggc

SEQ ID NO: 34592 - RNA, 180 nt, Artificial Sequence
  derived and/or modified sequence opt4 from anti-HIV_Chain
cccugcugcuucgccuacaucgccagaccccugcccagagcccacaucaaggaguacuucuacaccagcggcaagugcagcaaccccgccgugguguucgugaccagaaagaacagacaggugugcgccaaccccgagaagaagugggugagagaguacaucaacagccuggagaugagc

SEQ ID NO: 34593 - RNA, 249 nt, Artificial Sequence
  derived and/or modified sequence opt4 from anti-HIV_Chain
cuggaguggaugggcagaaucauccccgccaucgacgacgugaccuacgcccagaccuucagaggcagagugaccuucagcgccgacaaguucaccaccaccgccuacauggaccugaccggccugagaagcgaggacaccgccaccuacuucugcgccagagacccccaggugaacagaagaggcaacugcuucgaccacuggggccagggcacccuggugaccgugagcagcgccagcaccaagggc

SEQ ID NO: 34594 - RNA, 270 nt, Artificial Sequence
  derived and/or modified sequence opt4 from anti-HIV_Chain
gacguggugaugacccagagcccccugagccugcccgugacccugggccagcccgccagcaucagcugcagaagcagccagagccugguguacagccacggcgacaccuaccugaagugcuuccagcagagacccggccagagccccagaagacccaucuacaaggugagcaacagagacagcggcgugcccgacagauucagcggcagcggcagcggcaccgacuucacccugaagaucagcagaguggaggccgaggacgugggcgug

SEQ ID NO: 34595 - RNA, 294 nt, Artificial Sequence
  derived and/or modified sequence opt4 from anti-HIV_Chain
agcagcuucgccaucagcugggugagacaggcccccggccagggccuggaguggaugggcggcaucauccccaucuucgaggccaccagcuacgcccagaaguuccaggacagacugaccaucaccaccgacgagagcaccaccaccgccuacauggaccugagcagccugagaagcgaggacaccgccguguacuacugcgccagagcccagggcgacauccugaccgagggcuacuucgacuacuggggccagggcacccuggugaccgugagcagcgccagcaccaagggc

SEQ ID NO: 34596 - RNA, 297 nt, Artificial Sequence
  derived and/or modified sequence opt4 from anti-HIV_Chain
aacaccuucaccagccacuacgugcacugggugagacaggcccccggccagggccuggaguggaugggcaugaucaaccccggcggcaccaccagauacgcccccaaguuccaggacagagugacccugaccagagacaccagcaccagaaccguguacauggagcugagaagccugagaagcgaggacaccgccguguacuacugcgccagaccccaguacaaccugggcagagagccccugaacguguggggccagggcaccauggugaccgugagcagcgccagcaccaagggc

SEQ ID NO: 34597 - RNA, 297 nt, Artificial Sequence
  derived and/or modified sequence opt4 from anti-HIV_Chain
aucagaagcuucuacuggcacuggaucagacagagccccggcaagggccuggaguggcugggcagcguguucgacaacggccugaccacccacaaccccagccugaagagcagacugaccaucagcgaggaccccagcagaaaccagaucagccugaagcugagaagcaugaccgccgccgacaccgccguguacuacugcgccagaggcgacuacgacauccugaccagcagcuaccaguucgacuacuggggccagggcacccugguggccgugagcagcgccagcaccaagggc

SEQ ID NO: 34598 - RNA, 300 nt, Artificial Sequence
  derived and/or modified sequence opt4 from anti-HIV_Chain
cagagcgcccugacccagcccgccuucgugagcggcagccccggccagagcaucacccugagcugcacccugggcaccgaggacgugagcugguaccagcagagacccaacagcgcccccagacugaucaucuucgacgugaagaagagacccagcgacgugagcgacagauucagcggccacaacagcgacaccgccgccuuccugaccaucagcgagcugagacccgaggacgaggccgacuacuucugcaccagcuggcccuacagauucgacagaggcaccaagguggacguggcc

SEQ ID NO: 34599 - RNA, 300 nt, Artificial Sequence
  derived and/or modified sequence opt4 from anti-HIV_Chain
cagagcgcccugacccagcccgccuucgugagcggcagccccggccagagcaucacccugagcugcacccugggcaccgaggacgugagcugguaccagcagagacccaacagcgcccccagacugaucaucuucgacgugaagaagagacccagcgacgugagcgacagauucagcggccacaacagcgacaccgccgccuuccugaccaucagcgagcugagacccgaggacgaggccgaguacuucugcaccagcuggcccuacagauucggcagaggcaccaagguggacguggcc

SEQ ID NO: 34600 - RNA, 300 nt, Artificial Sequence
  derived and/or modified sequence opt4 from anti-HIV_Chain
cagagcgcccugacccaccccgccuucgugagcggcagccccggccagagcaucacccugagcugcacccugggcaccgaggacgugagcugguaccagcagagacccaacagcgcccccagacugaucaucuucgacgugagaaagagacccagcgaggugagcgacagauucagcggccacaagagcgacaccgccgccuuccugaccaucagcgaccugagacccgaggacgaggccgaguacuucugcaccagcuggcccuacagauucgacagaggcaccagacuggacguggcc

SEQ ID NO: 34601 - RNA, 300 nt, Artificial Sequence
  derived and/or modified sequence opt4 from anti-HIV_Chain
cagagcgugcugacccagcccgccuucgugagcggcagccccggccagagcaucaccaucagcugcaccgugggcaccaccgacgugagcugguaccagcagagacccaacagcgcccccagacugaucaucuucgacgugaagaagagacccagcggcgugagcgacagauucagcggcagcagcagcgacaacgccgccuuccugaccaucgccggccugagacccgaggacgaggccgaguacuacugcaccagcuggcccuacagauucggcagaggcaccaagguggacgugggc

SEQ ID NO: 34602 - RNA, 300 nt, Artificial Sequence
  derived and/or modified sequence opt4 from anti-HIV_Chain
cagagcgugcugacccagcccgccuucgugagcgccagccccggccagagcaucacccugagcugcaaccugggcaccgacuacgugagcugguaccagcagagacccagcagcgcccccagacugaucaucuucgacgugaagaacagacccagcggcgugagcgacagauucagcggcuacaacagcgacaccgccgccuuccugaccaucagcggccugcagcccgaggacgaggccgaguacuacugcaccagcuggcccuacaacuucggccccggcaccaagguggacgugacc

SEQ ID NO: 34603 - RNA, 300 nt, Artificial Sequence
  derived and/or modified sequence opt4 from anti-HIV_Chain
cagagcgugcugacccagcccgccagcgugagcggcagccccggccagagcaucaacaucagcugcgccggcagaagcgacagagugagcugguaccagcagagacccaacggcgugcccaagcugcugcuguucgacguguacagaagacccagcggcgugagcgacagauucagcggcagccacagcgacgacaccgccuuccugaccaucagcggccugcagaccgacgacgaggccgacuacuacugcaccagccaccccuacgccuucggccccggcaccaaggugaacgugcug

SEQ ID NO: 34604 - RNA, 300 nt, Artificial Sequence
  derived and/or modified sequence opt4 from anti-HIV_Chain
cagagcgugcugacccagcccgccuucgugagcggcagccccggccagagcaucacccugagcugcacccugggcaccgaggacgugagcugguaccagcagagacccaacagcgcccccagacugaucaucuucgacgugaagaagagacccagcgacgugagcgacagauucagcggccacaacagcgacaccgccgccuuccugaccaucagcgagcugagacccgaggacgaggccgaguacuucugcaccagcuggcccuacagauucggcagaggcaccaagguggacguggcc

SEQ ID NO: 34605 - RNA, 306 nt, Artificial Sequence
  derived and/or modified sequence opt4 from anti-HIV_Chain
cagagcgcccugacccagcccgccagcgugagcggcagccccggccagagcaucaccaucagcugcaccgccgacagcgacuacgugagcugguaccagcagagacccaacagcgcccccaagcugauccuguucgacgugaacagcagacccagcggcgugagcgacagauacagcggcagcagaagcggcaacaccgccagccugaccaucagcggccugcagagagaggacgaggccgacuacuucugcacccccuggcccuacgacuucagacccggcaccagaguguucgugcugggccag

SEQ ID NO: 34606 - RNA, 306 nt, Artificial Sequence
  derived and/or modified sequence opt4 from anti-HIV_Chain
cagagcgcccugacccagcccgccuucgugagcggcagccccggccagagcaucacccugagcugcagccugggcaccgccgacgugagcugguaccagcagagacccaacagcgcccccagacugaucaucuucgacgugaagaagagacccagcgacgugagcgacagauucagcggccacaacagcgacaccgccgccuucgugaccaucagcgagcugagacccgaggacgaggccgaguacuucugcaccagcuggcccuacagauucggccccggcaccaagguggacguggccagacag

SEQ ID NO: 34607 - RNA, 306 nt, Artificial Sequence
  derived and/or modified sequence opt4 from anti-HIV_Chain
cagagcgugcugacccagcccgccagcgugagcggcagccccggccagaccaucagcaucagcugcagcggcaccuucggcagcgacagcgugagcugguaccagcaguuccccaacagcgcccccacccugaucaucuucgacgugcacagaagacccagcggcaucagcaccagauucagcggcagcaccagcggcgacaccgccagccugaccaucagcacccugcacagagaggacgaggccuucuacuacugcaccagccaccccuacgacuucggcggcggcaccuacgugaucgugcug

SEQ ID NO: 34608 - RNA, 306 nt, Artificial Sequence
  derived and/or modified sequence opt4 from anti-HIV_Chain
cagagcgugcugacccagcccgccagcgugagcggcagccccggccagaccaucagcaucagcugcagcggcaccuucggcagcgacagcgugagcugguaccagcaguaccccaacagcgcccccacccugaucaucuucgacgugcacagaagacccagcggcaucagcaccagauucagcggcagcaccagcggcgacaccgccagccugaccaucagcacccugcacagagaggacgaggccuacuacuacugcaccagccaccccuacgacuucggcggcggcaccuacgugaucgugcug

SEQ ID NO: 34609 - RNA, 306 nt, Artificial Sequence
  derived and/or modified sequence opt4 from anti-HIV_Chain
cagagcgcccugacccagcccgccagcgugagcggcagccccggccagagcaucaacaucagcugcgccggcagaagcgacagagugagcugguaccagcagagacccaacggcgugcccaagcugcugauguucgacguguacagaagacccagcggcgugagcgacagauucagcggcagccacagcggcgacaccgccuuccugaccaucagcggccugcagaccgaggacgaggccgacuacuacugcaccagccaccccuacgccuucggcgccggcaccaaggugaacgugcugagacag

SEQ ID NO: 34610 - RNA, 306 nt, Artificial Sequence
  derived and/or modified sequence opt4 from anti-HIV_Chain
gacauccagaugacccagagccccagcagccugagcgccagcgugggcgacagagugagcauccacugccaggccggccagggcaucggcagcagccugaacugguaccagcagaagcccggcagagcccccagacugcuggugcacggcgccagcaaccugcagagaggcgugcccagcagauucagcggcagcggcuuccacaccaccuucacccugaccaucagcagccugcagcccgacgacguggccaccuacuggugcgccgcccuggaguucuucggccccggcaccaagguggagauc

SEQ ID NO: 34611 - RNA, 309 nt, Artificial Sequence
  derived and/or modified sequence opt4 from anti-HIV_Chain
gacauccagaugacccagagccccagcagccugagcgccagcgugggcgacaccgugaccaucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcagcccgaggacaucgccaccuacuucugccagguguacgaguucguggugcccggcaccagacuggaccugaagagaaccguggcc

SEQ ID NO: 34612 - RNA, 309 nt, Artificial Sequence
  derived and/or modified sequence opt4 from anti-HIV_Chain
gacauccagaugacccagagccccagcagccugagcgccagagugggcgacaccgugaccaucaccugccaggccaacggcuaccugaacugguaccagcagagaagaggcaaggcccccaagcugcugaucuacgacggcagcaagcuggagagaggcgugcccgccagauucagcggcagaagauggggccaggaguacaaccugaccaucaacaaccugcagcccgaggacguggccaccuacuucugccagguguacgaguucaucgugcccggcaccagacuggaccugaagagaaccguggcc

SEQ ID NO: 34613 - RNA, 309 nt, Artificial Sequence
  derived and/or modified sequence opt4 from anti-HIV_Chain
gacauccagaugacccagagccccagcagccugagcgccagagugggcgacaccgugaccaucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcagcccgaggacaucgccaccuacuucugccagguguacgaguucgccgugcccggcaccagacuggaccugaagagaaccguggcc

SEQ ID NO: 34614 - RNA, 309 nt, Artificial Sequence
  derived and/or modified sequence opt4 from anti-HIV_Chain
gacauccagaugacccagagccccagcagccugagcgccagcgugggcgacaccgugaccaucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcaggccgaggacaucgccaccuacuucugccagguguacgaguucgccgugcccggcaccagacuggaccugaagagaaccguggcc

SEQ ID NO: 34615 - RNA, 309 nt, Artificial Sequence
  derived and/or modified sequence opt4 from anti-HIV_Chain
gacauccagaugacccagagccccagcagccugagcgccagcgugggcgacaccgugaccaucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcagcccgaggacaucgccaccuacuucugccagguguacgaguucaucgugcccggcaccagacuggaccugaagagaaccguggcc

SEQ ID NO: 34616 - RNA, 309 nt, Artificial Sequence
  derived and/or modified sequence opt4 from anti-HIV_Chain
gacauccagaugacccagagccccagcagccugagcgccagagugggcgacaccgugaccaucaccugccaggccaacggcuaccugaacugguaccagcagagaagaggcaaggcccccaagcugcugaucuacgacggcagcaagcuggagaccggcgugcccagcagauucaccggcagaagauggggccaggaguacaaccugaccaucaacaaccugcagcccgaggacaucgccaccuacuucugccagguguacgaguucaucgugcccggcaccagacuggaccugaagagaaccguggcc

SEQ ID NO: 34617 - RNA, 312 nt, Artificial Sequence
  derived and/or modified sequence opt4 from anti-HIV_Chain
gacauccagaugacccagagccccagcagccugagcgccagcgugggcgacaaggugaccaucaccugccagaccagcgccggcuaccugaacugguaccagcagagaagaggcagagcccccaagcugcugauguacgacggcagcagacuggugaccggcgugcccagcagauucagcggcagaagauggggcacccaguacaaccugaccaucggcagccugcagcccgaggacguggccaccuacuacugccagguguacgaguucuucggccccggcaccagacuggaccugaagagaaccguggcc

SEQ ID NO: 34618 - RNA, 312 nt, Artificial Sequence
  derived and/or modified sequence opt4 from anti-HIV_Chain
gacauccagaugacccagagccccagcagccugagcgccagcgugggcgacaaggugaccaucaccugccagaccagcgccggcuaccugaacugguaccagcagagaagaggcagagcccccaagcugcugauguacgacggcagcagacuggugaccggcgugcccagcagauucagcggcagaagauggggcacccaguacaaccugaccaucggcagccugcagcccgaggacaucgccaccuacuacugccagguguacgaguucuucggccccggcaccagacuggaccugaagagcaccguggcc

SEQ ID NO: 34619 - RNA, 312 nt, Artificial Sequence
  derived and/or modified sequence opt4 from anti-HIV_Chain
gacauccagaugacccagagccccagcagccugagcgccagagugggcgacaccgugaccaucaccugccaggccaacggcuaccugaacugguaccagcagagaagaggcaaggcccccaagcugcugaucuacgacggcagcaagcuggagagaggcgugcccgccagauucagcggcagaagauggggccaggaguacaaccugaccaucaacaaccugcagcccgaggacguggccaccuacuucugccagguguacgaguucaucgugcccggcaccagacuggaccugaagagaaccguggccgcc

SEQ ID NO: 34620 - RNA, 312 nt, Artificial Sequence
  derived and/or modified sequence opt4 from anti-HIV_Chain
ugcaccgugagcggcggcagcaucaucagcuacuacuggaacuggaucagacagagccccggcaagggccuggaguggcugggcuacaucuucgacggcggcagagccaacuacaaccccagccugagaagcagacugaccaugagcguggacaccagcaagaaccagaucagccugaaggugaagagcgugaccgccgccgacagcgccaucuacuacugcgccagacuggacggcgaggccuucagauacuacuucgacagcuggggccagggcacccuggugaccgugagcagcgccagcaccaagggc

SEQ ID NO: 34621 - RNA, 312 nt, Artificial Sequence
  derived and/or modified sequence opt4 from anti-HIV_Chain
gugagcggcggcagauucagcaacuacggccugagcugggugagacaggcccccggccagggccuggaguggaugggcagaaucgugcccgccaucaacagagccaaguacgcccagaaguuccagggcagagugauccugaccgccgacaagaucaccgacaccgccuacauggagcugagaagccugagaagcgaggacaccgccaucuucuacugcgccagagacccccagaucgagaucagaggcaacgccuucgacaucuggggccagggcaccguggugaccgugagcagcgccagcaccaagggc

SEQ ID NO: 34622 - RNA, 315 nt, Artificial Sequence
  derived and/or modified sequence opt4 from anti-HIV_Chain
agcgacaucagcguggcccccggcgagaccgccagaaucagcugcggcgagaagagccugggcagcagagccgugcagugguaccagcacagagccggccaggcccccagccugaucaucuacaacaaccaggacagacccagcggcauccccgagagauucagcggcagccccgacagccccuucggcaccaccgccacccugaccaucaccagcguggaggccggcgacgaggccgacuacuacugccacaucugggacagcagagugcccaccaaguggguguucggcggcggcaccacccugaccgugcug

SEQ ID NO: 34623 - RNA, 315 nt, Artificial Sequence
  derived and/or modified sequence opt4 from anti-HIV_Chain
agcagcaugagcgugagccccggcgagaccgccaagaucagcugcggcaaggagagcaucggcagcagagccgugcagugguaccagcagaagagcggccagccccccagccugaucaucuacaacaaccaggacagacccagcggcgugcccgagagauucagcgccacccccgacuucggcgccggcaccaccgccacccugaccaucaccaacguggaggccgacgacgaggccgacuacuacugccacaucuacgacgccagaggcggcaccaacuggguguucgacagaggcgccacccugaccgugcug

SEQ ID NO: 34624 - RNA, 315 nt, Artificial Sequence
  derived and/or modified sequence opt4 from anti-HIV_Chain
agcuucgugagcguggcccccggccagaccgccagaaucaccugcggcgaggagagccugggcagcagaagcgugaucugguaccagcagagacccggccaggcccccagccugaucaucuacaacaacaacgacagacccagcggcauccccgagagauucagcggcagccccggcagcaccuucggcaccaccgccacccugaccaucaccagcguggaggccggcgacgaggccgacuacuacugccacaucugggacagcagaagacccaccaacuggguguucggcgagggcaccacccugaccgugcug

SEQ ID NO: 34625 - RNA, 315 nt, Artificial Sequence
  derived and/or modified sequence opt4 from anti-HIV_Chain
agcuucgugagcguggcccccggccagaccgccagaaucaccugcggcgaggagagccugggcagcagaagcgugaucugguaccagcagagacccggccaggcccccagccugaucauguacaacaaccacgacagacccagcggcauccccgagagauucagcggcagccccggcagcaccuucggcaccaccgccacccugaccaucaccagcguggaggccggcgacgaggccgacuacuacugccacaucugggacagcagaagacccaccaacuggguguucggcgagggcaccacccugaccgugcug

SEQ ID NO: 34626 - RNA, 315 nt, Artificial Sequence
  derived and/or modified sequence opt4 from anti-HIV_Chain
gacauccagaugacccagagccccagcagccugagcgccagcgugggcgacaaggugaccaucaccugccagaccagcgccggcuaccugaacugguaccagcagagaagaggcagagcccccaagcugcugauguacgacggcagcagacuggugaccggcgugcccagcagauucagcggcagaagauggggcacccaguacaaccugaccaucggcagccugcagcccgaggacaucgccaccuacuacugccagguguacgaguucuucggccccggcaccagacuggaccugaagagcaccguggccgcc

SEQ ID NO: 34627 - RNA, 315 nt, Artificial Sequence
  derived and/or modified sequence opt4 from anti-HIV_Chain
gacauccagaugacccagagccccagcagccugagcgccagcgugggcgacagagugagcaucaacugccaggccggccagggccugggcagcagccugaacugguaccagcagaagcccggcagagcccccaagcugcuggugcacggcgccagcaaccugcagagaggcgugcccagcagauucagcggcagcggcuuccacaccaccuucacccugaccaucagcagccugcagcccgacgacguggccaccuacuucugcgccgccuuccagugguucggccccggcaccaagguggagaucaagagaacc

SEQ ID NO: 34628 - RNA, 318 nt, Artificial Sequence
  derived and/or modified sequence opt4 from anti-HIV_Chain
ugcaccgugagcggcggcagcaucagcagcgccggcuacuacuggaccuggaucagacagcaccccggcaagggccuggaguucaucggcuacaucuacuacaucggcaccaccuacuacaaccccagccugaagagcagacugaccaucagcaucgacaccagcaagaaccaguucagccugaagcugagcagcgugaccgccgccgacaccgccaucuacuacugcgccagagacuacaccgccagaggcagacacuucuucgacuacuggggccagggcgcccuggugaccgugagcagcgccagcaccaagggc

SEQ ID NO: 34629 - RNA, 321 nt, Artificial Sequence
  derived and/or modified sequence opt4 from anti-HIV_Chain
agcagccugccccugagccuggcccccggcgccaccgccaagauccccugcggcgagaagagcagaggcagcagagccgugcagugguaccagcagaagcccggccaggcccccacccugaucaucuacaacaaccaggacagacccgccggcgugagcgagagauacagcggcaaccccgacguggccaucggcgugaccgccacccugaccaucagcagaguggaggccggcgacgaggccgaguacuacugccacuacugggacagcagaagccccaucagcuggguguucggcggcuggacccagcugaccgugcug

SEQ ID NO: 34630 - RNA, 321 nt, Artificial Sequence
  derived and/or modified sequence opt4 from anti-HIV_Chain
agcagccugccccugagcguggcccccggcgccaccgccaagaucgccugcggcgagaagagcuucgccagcagagccgugcagugguaccagcagaagcccggccaggcccccgugcugaucaucuacaacaaccaggacagacccgccggcgugagcgagagauucagcggcacccccgacgugggcuucggcagcaccgccacccugaccaucagcagaguggaggccggcgacgaggccgacuacuacugccacaagugggacagcagaagcccccugagcuggguguucggcggcggcacccagcugaccgugcug

SEQ ID NO: 34631 - RNA, 321 nt, Artificial Sequence
  derived and/or modified sequence opt4 from anti-HIV_Chain
gacauccagaugacccagagccccagcagccugagcgccagcaucggcgacagagugaccaucaccugcagagccagccaggacaucgccaacuaccugaacugguaccagaagaagagcggcaccccccccaagcugcugaucuucgccgccaccaaccugcacagaggcgugagccccagauucaccggcagcggccacggcacccacuucagccugaccaucaccaacgugcagcacgaggacuucggcaacuacuucugccagcagagcuucgccaccgugggcagcuucggccagggcaccuggguggacaucaga

SEQ ID NO: 34632 - RNA, 321 nt, Artificial Sequence
  derived and/or modified sequence opt4 from anti-HIV_Chain
gacauccagaugacccagagccccagcagccugagcgccagcaucggcgacagagugaccaucaccugcagagccagccaggacaucgccaacuaccugaacugguaccagaagaagagcggcaccccccccaagcugcugaucuucgccgccaccaaccugcacagaggcgugagccccagauucaccggcagcggccacggcacccacuucagccugaccaucaccaacgugcagcacgaggacuucggccacuacuucugccagcagagcuucgccaccgugggcagcuucggccagggcaccuggguggacaucaga

SEQ ID NO: 34633 - RNA, 321 nt, Artificial Sequence
  derived and/or modified sequence opt4 from anti-HIV_Chain
gacauccagaugacccagagccccagcagccugagcgccagcgugggcgacagagugaccaucaccugcagagccagccaggacaucgccaacuaccugaacugguaccagaagaagagcggcaccccccccaagcugcugaucuucgccgccaccaaccugcacagaggcgugagccccagauucagcggcagcggcagcggcacccacuucagccugaccaucaccaacgugcaguacgaggacuucgccaacuacuucugccagcacagcuucggcaccaucggcaccuucggccagggcaccuggguggacaucaga

SEQ ID NO: 34634 - RNA, 321 nt, Artificial Sequence
  derived and/or modified sequence opt4 from anti-HIV_Chain
gacauccagaugacccagagccccagcagccugagcgccagcaucggcgacagagugaccaucaccugcagagccagccaggacaucgccaacuaccugaacugguaccagaagaagagcggcaccccccccaagcugcugaucuucggcgccaccaaccugcaccacggcgugagccccagauucagcggcagcggccacggcacccacuucagccugaccaucaccaacgugcagcacgaggacuucgccaacuacuucugccagcagagcuuccagaccgugggcagcuucggccagggcaccuggguggacaucaga

SEQ ID NO: 34635 - RNA, 321 nt, Artificial Sequence
  derived and/or modified sequence opt4 from anti-HIV_Chain
gagaucgugcugacccagagccccgccacccugagccugagccccggcgagaccgccaucaucagcugcagaaccagccagagcggcagccuggccugguaccagcagagacccggccaggcccccagacuggugaucuacagcggcagcaccagagccgccggcauccccgacagauucagcggcagcagauggggcgccgacuacaaccugagcaucagcaaccuggagagcggcgacuucggcguguacuacugccagcaguacgaguucuucggccagggcaccaaggugcagguggacaucaagagaaccguggcc

SEQ ID NO: 34636 - RNA, 321 nt, Artificial Sequence
  derived and/or modified sequence opt4 from anti-HIV_Chain
gacauccagaugacccagagccccagcagccugagcgccagcaucggcgacagagugaacaucaccugccaggccagcagagacaccggcagcgcccugaacugguaccagcagaaggugggcagaccccccagacugcugaucagcgccgugagcaaccugggcgccggcgugcccagcagauucagcggcagaagaagcggcacccagagcacccugaccaucaacacccugcagcccgaggacaucgccaccuacuucugccagcacuacgaguucuucggccccggcaccaagguggacaucaagagaaccguggcc

SEQ ID NO: 34637 - RNA, 321 nt, Artificial Sequence
  derived and/or modified sequence opt4 from anti-HIV_Chain
gacauccagaugacccagagccccagcagccugagcgccagcgugggcgacagagugaccaucaccugccaggccggccagggcaucggcagcagccugcagugguaccagcagaagcccggcaaggcccccaagcugcuggugcacggcgccagcaaccugcacagaggcgugcccagcagauucagcggcagcggcuuccacaccaccuucagccugaccaucagcggccugcagagagacgacuucgccaccuacuucugcgccgugcuggaguucuucggccccggcaccaagguggagaucaagagaaccguggcc

SEQ ID NO: 34638 - RNA, 324 nt, Artificial Sequence
  derived and/or modified sequence opt4 from anti-HIV_Chain
agcuacgugagaccccugagcguggcccugggcgagaccgccagcaucagcugcggcagacaggcccugggcagcagagccgugcagugguaccagcacagacccggccaggcccccauccugcugaucuacaacaaccaggacagacccagcggcauccccgagagauucagcggcacccccgacaucaacuucggcaccagagccacccugaccaucagcggcguggaggccggcgacgaggccgacuacuacugccacaugugggacagcagaagcggcuucagcuggagcuucggcggcgccaccagacugaccgugcug

SEQ ID NO: 34639 - RNA, 324 nt, Artificial Sequence
  derived and/or modified sequence opt4 from anti-HIV_LightChain
gacauccugaugacccagagccccagccugcugagcgccagcgugggcgacagagugaccaucaccugcaaggccagccaggacgugagcaccgccguggccugguaccagcagaagcccggcaaggcccccaagcugcugaucuacugggccagcaccagacacaccggcgugcccagcagauucaccggcagcggcagcggcaccgacuucacccugaccaucagcagacugcaggccgaggacuucgcccuguacuacugccagcagcacuacaccacccccuggaccuucggcggcggcaccaagguggagaucaagaga

SEQ ID NO: 34640 - RNA, 324 nt, Artificial Sequence
  derived and/or modified sequence opt4 from anti-HIV_LightChain
gacaucgugaugacccagagccccagccugcugagcgccagcgugggcgacagagugaccaucaccugcaaggccagccaggacgugagcaccgccguggccugguaccagcagaagcccggcaaggcccccaagcugcugaucuacugggccagcaccagacacaccggcgugcccagcagauucagcggcagcggcagcggcaccgacuucacccugaccaucagcagccugcagcccgaggacuucgcccuguacuacugccagcagcacuacaccacccccuggaccuucggcggcggcaccaagguggagaucaagaga

SEQ ID NO: 34641 - RNA, 324 nt, Artificial Sequence
  derived and/or modified sequence opt4 from anti-HIV_Chain
gacauccagaugacccagagccccagcagccugagcgccagcgugggcgacaccgugaccaucaacugccagaccaacaagggcuaccugaacugguaccagcagagaagaggcagagcccccaagcugcugauguacgacggcagcaagcuggugaccggcgugcccagcagauucagcggcagaagauggggcacccaguacaaccugaccaucggcagccugcagcccgaggacaucgccaccuacuacugccagguguacgaguucuucggccccggcaccagacuggaccugaagagaaccguggccgcccccagcgac

SEQ ID NO: 34642 - RNA, 333 nt, Artificial Sequence
  derived and/or modified sequence opt4 from anti-HIV_Chain
cugagcgccuacgugggcgacagagugaccaucaccugcagagccagccagaacaucaacaccuaccugaacugguaccagcagagacccggcaaggcccccaagcugcugaucuacgccgccagcacccugcagagcggcgugcccagcagauucagcggcagcggcagcggcaccgacuucacccugaccaucagcaaccuggagaccgaggacuucgccguguacuacugccagcagaccuacagcagcgugaccuucggccagggcaccaagcuggagaccagaagaaccguggccgcccccagcguguucaucuucccccccagcgac

SEQ ID NO: 34643 - RNA, 333 nt, Artificial Sequence
  derived and/or modified sequence opt4 from anti-HIV_Chain
gagaucgugcugacccagagccccgccacccugagccugagccccggcgagagagccacccugagcugcagagccagccagggcgugaacuucguggugugguaccagcagaagagaggccaggcccccagacugcugaucuacggcaacagcgacagagugcccggcgugcccgacagauucagcgccagaggcagcggcaccgaguucagccuggugaucagcagcguggagcccgacgacuucgcccuguacuacugccaggaguacagcagcacccccuacaacuucggccccggcaccagaguggacagaaagagaaccguggccgcc

SEQ ID NO: 34644 - RNA, 336 nt, Artificial Sequence
  derived and/or modified sequence opt4 from anti-HIV_HeavyChain
gaggugaagcuggaggagagcggcggcggccuggugcagcccggcggcagcagaaagcugagcugcgccgccagcggcuucaccuucagcagcuucggcaugcacugggugagacaggcccccgagaagggccuggaguggguggccuacaucagcagcggcagcagcacccugcacuacgccgacaccgugaagggcagauucaccaucagcagagacaaccccaagaacacccuguuccugcagaugaagcugcccagccugugcuacggccugcugggcagcagaaaccugagccacagacugcugagccagaacgacacccccaucugccug

SEQ ID NO: 34645 - RNA, 336 nt, Artificial Sequence
  derived and/or modified sequence opt4 from anti-HIV_Chain
gagaucgugcugacccagagccccgccacccugagccugagccccggcgagagagccacccugagcugcagagccagccagggcgugaacuucguggugugguaccagcagaagagaggccaggcccccagacugcugaucuacggccccagcgacagagcccccggcgugcccgacagauucagcgccagaggcagcggcaccgaguucagccuggugaucagcagcguggagcccgacgacuucgcccuguacuacugccaggaguacagcagcacccccuacaacuucggcaccggcaccagaguggacagaaagagaaccguggccgccccc

SEQ ID NO: 34646 - RNA, 336 nt, Artificial Sequence
  derived and/or modified sequence opt4 from anti-HIV_Chain
cagacccugagccugaccugcagcgugagcggcggcagcaucagcagcgccggcuacuacuggggcuggaucagacagcaccccggcaagggccuggaguggaucggccacaucuacuacagcggcaacaccaacuacaaccccagccugaagagcagacugagcaugagcguggagaccagcaagaaccaguucagccugaaccuggccagcgugaccgccgccgacaccgccguguacuucugcgccagagacuacagcgccgccggcagacaccuguucgacagcuggggccagggcauccuggugaccgugagcagcgccagcaccaagggc

SEQ ID NO: 34647 - RNA, 336 nt, Artificial Sequence
  derived and/or modified sequence opt4 from anti-HIV_LightChain
gacaucgugaugacccagcagaccccccugacccugagcaucaccaucggccagcccgccagcaucagcugcaagagcagccagagccugcuggacagcgacggcaagaccuaccugaacuggcugcugcagagacccggccagagccccaagagacugaucuacuggaugagcaagcuggacagcggcgugcccgacagauucaccggcagcggcagcggcaccgacuucacccugaagaucagcagaguggaggccgaggaccugggcguguacuacugcuggcagggcacccacuuccccuggaccuucggcggcggcaccaagcuggagcug

SEQ ID NO: 34648 - RNA, 339 nt, Artificial Sequence
  derived and/or modified sequence opt4 from anti-HIV_LightChain
gacaucgugaucacccagagcaccaaguucaugagcaccagcgugggcgacagagugagcaucaccugcaaggccagccaggacgugagcaccgccguggccugguaccagcagaagcccggccagagccccaagcugcugaucuacugggccagcaccagacacaccggcgugcccgacagauucaccggcagcggcagcggcaccgacuacacccugaccaucagcagagugcaggccgaggaccuggcccuguacuacugccagcagcacuacaccacccccuggaccuucggcggcggcaccaagcuggagaucaagagaaccguggccgccccc

SEQ ID NO: 34649 - RNA, 339 nt, Artificial Sequence
  derived and/or modified sequence opt4 from anti-HIV_Chain
gacauccagaugacccagagccccagcagccugagcgccagagugggcgacaccgugaccuucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcagcccgaggacaucgccaccuacuucugccagguguacgaguucgccgugcccggcaccagacuggaccugaagagaaccguggccgcccccagcguguucaucuuccccagcgac

SEQ ID NO: 34650 - RNA, 339 nt, Artificial Sequence
  derived and/or modified sequence opt4 from anti-HIV_Chain
cagagcgugcugacccagcccgccagcgugagcggcagccccggccagagcaucaccaucagcugcaccggcaccaacagcgacgugggcuacagcuacgugagcugguuccagcagcaccccggcaaggugcccaagcugcugaucuacgacgugagcagaagaagcagcggcgugagcaacagauucagcggcagcagaagcggcaacaccgccagccugaccaucagcggccugagagccgaggacgaggccgacuacuacugcggcagcuucaccaccagccugacccugguguucggcggcggcaccaagcuggccgugcuggugagccccagc

SEQ ID NO: 34651 - RNA, 339 nt, Artificial Sequence
  derived and/or modified sequence opt4 from anti-HIV_Chain
agccugagcgccagcgugggcgacagagugaccaucaccugcagagccagcgagagcaucagcuucuaccugaacugguaccagcagaagcccggcaaggcccccgagcugcugaucuucgccaccagcacccugcacagcggcgugcccagcagauucagcggcagcggcagcggcaccgacuucacccugaccaucagcagccugcagcuggaggacuucgccaccuacuacugccagcagagcagcagcacccccuucaccuucggcggcggcaccaagguggagaucaagagaaccguggccgcccccagcguguucaucuucccccccagcgac

SEQ ID NO: 34652 - RNA, 342 nt, Artificial Sequence
  derived and/or modified sequence opt4 from anti-HIV_Chain
gacauccagaugacccagagccccagcagccugagcgccagcgugggcgacaccgugaccaucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcagcccgaggacaucgccaccuacuucugccagguguacgaguucaucgugcccggcaccagacuggaccugaagagaaccguggccgcccccagcguguucaucuucccccccagcgac

SEQ ID NO: 34653 - RNA, 342 nt, Artificial Sequence
  derived and/or modified sequence opt4 from anti-HIV_Chain
gacauccagaugacccagagccccagcagccugagcgccagagugggcgacaccgugaccaucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcagcccgaggacaucgccaccuacuucugccagguguacgaguucgccgugcccggcaccagacuggaccugaagagaaccguggccgcccccagcguguucaucuucccccccagcgac

SEQ ID NO: 34654 - RNA, 342 nt, Artificial Sequence
  derived and/or modified sequence opt4 from anti-HIV_Chain
gacauccagaugacccagagccccagcagccugagcgccagagugggcgacaccgugaccaucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcagcccgaggacaucgccaccuacuucugccagguguacgaguucguggugcccggcaccagacuggaccugaagagaaccguggccgcccccagcguguucaucuucccccccagcgac

SEQ ID NO: 34655 - RNA, 342 nt, Artificial Sequence
  derived and/or modified sequence opt4 from anti-HIV_Chain
gacauccagaugacccagagccccagcagccugagcgccagagugggcgacaccgugaccuucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcagcccgaggacaucgccaccuacuucugccagguguacgaguucgccgugcccggcaccagacuggaccugaagagaaccguggccgcccccagcguguucaucuucccccccagcgac

SEQ ID NO: 34656 - RNA, 342 nt, Artificial Sequence
  derived and/or modified sequence opt4 from anti-HIV_Chain
gacauccagaugacccagagccccagcagccugagcgccagcgugggcgacaccgugaccaucaccugccaggccaacggcuaccugaacugguaccagcagagaagaggcaaggcccccaagcugcugauguacgacggcagcacccuggagagaggcgugcccgccagauucagcggcagaagauggggccaggaguacaaccugaccaucaacaaccugcagcccgaggacguggccaccuacuucugccagguguacgaguucaucgugcccggcaccagacuggaccugaagagaaccguggccgcccccagcguguucaucuucccccccagcgac

SEQ ID NO: 34657 - RNA, 342 nt, Artificial Sequence
  derived and/or modified sequence opt4 from anti-HIV_Chain
gacauccagaugacccagagccccagcagccugagcgccagcgugggcgacaccgugaccaucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcaggccgaggacaucgccaccuacuucugccagguguacgaguucgccgugcccggcaccagacuggaccugaagagaaccguggccgcccccagcguguucaucuucccccccagcgac

SEQ ID NO: 34658 - RNA, 342 nt, Artificial Sequence
  derived and/or modified sequence opt4 from anti-HIV_Chain
gacauccagaugacccagagccccagcagccugagcgccagcgugggcgacaccgugaccuucaccugccaggccaacggcuaccugaacugguaccagcagagaagaggcaaggcccccaagcugcugaucuacgacggcagcagacuggagagaggcgugcccagcagauucagcggcagaagauggggccaggaguacaaccugaccaucaacaaccugcagcccgaggacaucgccaccuacuucugccagguguacgaguucgccgugcccggcaccagacuggaccugaagagaaccguggccgcccccagcguguucaucuucccccccagcgac

SEQ ID NO: 34659 - RNA, 342 nt, Artificial Sequence
  derived and/or modified sequence opt4 from anti-HIV_Chain
gacauccagaugacccacagccccagcagccugagcgccagcgugggcgacaccgugaccaucaccugccaggccaacggcuaccugaacugguaccagcagagaagaggcaaggcccccaagcugcugaucuacgacggcagcaagcuggagaccggcgugcccagcagauucaccggcagaagauggggccaggaguacaaccugaccaucaacaaccugcagcccgaggacaucgccaccuacuucugccagguguacgaguucaucgugcccggcaccagacuggaccugaagagaaccguggccgcccccagcguguucaucuucccccccagcgac

SEQ ID NO: 34660 - RNA, 342 nt, Artificial Sequence
  derived and/or modified sequence opt4 from anti-HIV_Chain
gacauccagaugacccagagccccagcagccugagcgccagagugggcgacaccgugaccaucaccugccaggccaacggcuaccugaacugguaccagcagagaagaggcaaggcccccaagcugcugaucuacgacggcagcaagcuggagaccggcgugcccagcagauucaccggcagaagauggggccaggaguacaaccugaccaucaacaaccugcagcccgaggacaucgccaccuacuucugccagguguacgaguucaucgugcccggcaccagacuggaccugaagagaaccguggccgcccccagcguguucaucuucccccccagcgac

SEQ ID NO: 34661 - RNA, 342 nt, Artificial Sequence
  derived and/or modified sequence opt4 from anti-HIV_Chain
gacauccagaugacccagagccccagcagccugagcgccagagugggcgacaccgugaccuucaccugccaggccaacggcuaccugaacugguaccagcagagaagaggcaaggcccccaagcugcugaucuacgacggcagcaagcuggagagaggcgugcccagcagauucagcggcagaggcuggggccaggaguacaaccugaccaucaacaaccugcagcccgaggacaucgccaccuacuucugccagguguacgaguucgccgugcccggcaccagacuggaccugaagagaaccguggccgcccccagcguguucaucuucccccccagcgac

SEQ ID NO: 34662 - RNA, 342 nt, Artificial Sequence
  derived and/or modified sequence opt4 from anti-HIV_Chain
gacauccagaugacccagagccccagcagccugagcgccagcgugggcgacaccgugaccaucaccugccaggccaacggcuaccugaacugguaccagcagagaagaggcaaggcccccaagcugcugaucuacgacggcagcaagcuggagagaggcgugcccagcagauucagcggcagaagauggggccaggaguacaaccugaccaucaacaaccugcagcccgaggacaucgccaccuacuucugccagguguacgaguucguggugcccggcaccagacuggaccugaagagaaccguggccgcccccagcguguucaucuucccccccagcgac

SEQ ID NO: 34663 - RNA, 342 nt, Artificial Sequence
  derived and/or modified sequence opt4 from anti-HIV_Chain
agccagagcguggugacccaggagcccagccugaccgugagccccggcggcaccgugacccugaccugcggccccagcaccggcgccgugaccagcggcuucuacccccacugguuccagcagaagcccggccaggcccccagagcccugaucuacagcaccagcaacaaguacagcuggacccccgccagauucagcggcagccugcugggcggcaaggccgugcugacccugagcgacgugcagcccgacgacgaggccgaguacuacugccugcugcugcuguacuacggcggccccuggaucuucggcggcggcaccaagcugaccgugcuggugagc

SEQ ID NO: 34664 - RNA, 345 nt, Artificial Sequence
  derived and/or modified sequence opt4 from anti-HIV_Chain
gacauccagaugacccagagccccagcagccugagcgccagcgugggcgacaaggugaccaucaccugccagaccagcgccggcuaccugaacugguaccagcagagaagaggcagagcccccaagcugcugauguacgacggcagcagacuggugaccggcgugcccagcagauucagcggcagaagauggggcacccaguacaaccugaccaucggcagccugcagcccgaggacguggccaccuacuacugccagguguacgaguucuucggccccggcaccagacuggaccugaagagaaccguggccgcccccagcguguucaucuucccccccagcgac

SEQ ID NO: 34665 - RNA, 345 nt, Artificial Sequence
  derived and/or modified sequence opt4 from anti-HIV_Chain
gacauccagaugacccagagccccagcagccugagcgccagcgugggcgacaccgugaccaucaccugccagaccaccaagggcuaccugaacugguaccagcagagaagaggcagagcccccaagcugcugauguucgacggcagcaagcuggugaccggcgugcccagcagauucagcggcagaagauggggcacccaguacaaccugaccaucggcagccugcagcccgaggaccuggccaccuacuacugccagguguacgaguucuucggccccggcaccagacuggaccugaagagaaccguggccgcccccagcguguucaucuucccccccagcgac

SEQ ID NO: 34666 - RNA, 345 nt, Artificial Sequence
  derived and/or modified sequence opt4 from anti-HIV_Chain
gacauccagaugacccagagccccagcagccugagcgccagcgugggcgacaccgugaccaucaccugccagaccaacaagggcuaccugaacugguaccagcagagaagaggcagagcccccaagcugcugaugugcgacggcagcaagcuggugaccggcgugcccagcagauucagcggcagaagauggggcacccaguacaaccugaccaucggcagccugcagcccgaggacaucgccaccuacuacugccagguguacgaguucuucggccccggcaccagacuggaccugaagagaaccguggccgcccccagcguguucaucuucccccccagcgac

SEQ ID NO: 34667 - RNA, 345 nt, Artificial Sequence
  derived and/or modified sequence opt4 from anti-HIV_Chain
gacauccagaugacccagagccccagcagccugagcgccagagugggcgacaaggugaccaucaccugccagaccagcgccggcuaccugaacugguaccagcagagaagaggcagagcccccaagcugcugauguacgacggcagcagacuggugaccggcgugcccagcagauucagcggcagaagauggggcacccaguacaaccugaccaucggcagccugcagcccgaggacaucgccaccuacuacugccagguguacgaguucuucggccccggcaccagacuggaccugaagagaaccguggccgcccccagcguguucaucuucccccccagcgac

SEQ ID NO: 34668 - RNA, 345 nt, Artificial Sequence
  derived and/or modified sequence opt4 from anti-HIV_Chain
gacauccagaugacccagagccccagcagccugagcgccagcgugggcgacaccgugaccaucaccugccagaccaacaagggcuaccugaacugguaccagcagaagagaggcagagcccccaagcugcugauguacgacggcagcaagcuggugaccggcgugcccagcagacugagcggcagaagauggggcacccaguacaaccugaccaucggcagccugcagcccgaggacaucgccaccuacuacugccagguguacgaguucuucggccccggcaccagacuggaccugaagagaaccguggccgcccccagcguguucaucuucccccccagcgac

SEQ ID NO: 34669 - RNA, 345 nt, Artificial Sequence
  derived and/or modified sequence opt4 from anti-HIV_Chain
gacauccagaugacccagagccccagcagccugagcgccagcgugggcgacaccgugaccaucaccugccagaccaacaagggcuaccugaacugguaccagcagagaagaggcagagcccccaagcugcugauguacgacggcagcaagcuggugaccggcgugcccagcagacugagcggcagaagauggggcacccaguacaaccugaccaucggcagccugcagcccgaggacaucgccaccuacuacugccagguguacgaguucuucggccccggcaccagacuggaccugaagagaaccguggccgcccccagcguguucaucuucccccccagcgac

SEQ ID NO: 34670 - RNA, 345 nt, Artificial Sequence
  derived and/or modified sequence opt4 from anti-HIV_Chain
gacauccagaugacccagagccccagcagccugagcgccagcgugggcgacaccgugaccaucaccugccacaccaacaagggcuaccugaacugguaccagcagagaagaggcagagcccccaagcugcugauguucgacggcagcaagcuggugaccggcgugcccagcagauucagcggcagaagauggggcacccaguacaaccugaccaucggcagccugcagcccgaggacaucgccaccuacuacugccagguguacgagguguucggccccggcaccagacuggaccugaagagaaccguggccgcccccagcguguucaucuucccccccagcgac

SEQ ID NO: 34671 - RNA, 345 nt, Artificial Sequence
  derived and/or modified sequence opt4 from anti-HIV_Chain
gacauccagaugacccagagccccagcagccugagcgccagcgugggcgacaccgugaccaucaacugccagaccaacaagggcuaccugaacugguaccagcagagaagaggcagagcccccaagcugcugauguacgacggcagcaagcuggugaccggcgugcccagcagauucagcggcagaagauggggcacccaguacaaccugaccaucggcagccugcagcccgaggacaucgccaccuacuacugccagguguacgaguucuucggccccggcaccagacuggaccugaagagaaccguggccgcccccagcguguucaucuucccccccagcgac

SEQ ID NO: 34672 - RNA, 345 nt, Artificial Sequence
  derived and/or modified sequence opt4 from anti-HIV_Chain
gacauccagaugacccagagccccagcagccugagcgccagagugggcgacaaggugaccaucaccuaccagaccagcgccggcuaccugaacugguaccagcagagaagaggcagagcccccaagcugcugauguacgacggcagcagacuggugaccggcgcccccagcagauucagcggcagaagauggggcacccaguacaaccugaccaucggcagccugcagcccgaggacaucgccaccuacuacugccagguguacgaguucuucggccccggcaccagacuggaccugaagagaaccguggccgcccccagcguguucaucuucccccccagcgac

SEQ ID NO: 34673 - RNA, 345 nt, Artificial Sequence
  derived and/or modified sequence opt4 from anti-HIV_Chain
gacauccagaugacccagagccccagcagccugagcgccagcgugggcgacaccgugaccaucaccugccagaccaacaagggcuaccugaacugguaccagcagagaagaggcagagcccccaagcugcugauguacgacggcagcaagcuggugaccggcgugcccagcagauucagcggcagaagauggggcacccaguacaaccugaccaucggcagccugcagcccgaggacaucgccaccuacuacugccagguguacgaguucuucggccccggcaccagacuggaccugaagagaaccguggccgcccccagcguguucaucuucccccccagcgac

SEQ ID NO: 34674 - RNA, 345 nt, Artificial Sequence
  derived and/or modified sequence opt4 from anti-HIV_Chain
gugacccugagccugagccccggcgagagagccacccugagcugcagagccagccagaccaucagcaacaacuaccuggccugguaccagcagaagcccggccaggcccccagacugcugaucuacggcgccagcagcggcgccaccggccugcccgacagauucagcggcagcggcagcggcaccgacuucacccugaccaucagcagacuggagcccgaggacuucgccguguacuacugccaccaguacgcccugagccccuggaccuucggcagaggcaccaagguggagaucaagagaaccguggccgcccccagcguguucaucuucccccccagcgac

SEQ ID NO: 34675 - RNA, 345 nt, Artificial Sequence
  derived and/or modified sequence opt4 from anti-HIV_Chain
acccugagcgccagcgugggcgacagagugaccaucaccugcagagccagccagagcaucaacaacuaccugaacugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgugaccuacuacugccagcagaccuacagcaaccccagaauguucggccagggcaccaagguggagaucaagagaaccguggccgcccccagcguguucaucuucccccccagcgacgagcag

SEQ ID NO: 34676 - RNA, 345 nt, Artificial Sequence
  derived and/or modified sequence opt4 from anti-HIV_Chain
cagagcgcccugacccaggcccccagcgccagcggcacccccggccagagagugaccaucagcugcagcggcggcggcagcaacaucggcggcaaccuggugagcugguaccagcacuuccccggcgccgcccccaagcugcugaucuacagaaacgaccagagacccagcggcgugcccgacagauucagcgccagcaagagcggcaccagcgccagccuggccaucagcggccugagaagcgacgacgaggccaccuacuucugcgccgccuacgacagcacccugagccugagacuguucggcggcggcaccacccuggccgugcugagccagcccaaggcc

SEQ ID NO: 34677 - RNA, 345 nt, Artificial Sequence
  derived and/or modified sequence opt4 from anti-HIV_Chain
aagcccagccagacccugagccugaccugcaccgugagcggcggcagcaucagcagcgccggcuacuacuggaccuggaucagacaccaccccggcaagggccuggaguucaucggcuacaucuaccacaucggcacccccuacuacaaccccagccugaagagcagacugaccaucagcaucgacaccagcaagaaccaguucagccugaagcugagcagcgugaccgccgccgacaccgccaucuacuacugcgccagagacuacaccgccagaggcagacacuucuucgacuacuggggccagggcgcccuggugaccgugagcagcgccagcaccaagggc

SEQ ID NO: 34678 - RNA, 345 nt, Artificial Sequence
  derived and/or modified sequence opt4 from anti-HIV_Chain
cccagcgagacccugagccugaccugcagagugagcggcgccagcaucagcaacuucuacuggaccuggaucagacagcccgccggcaagggccuggaguggaucggcagacuguacagcagcgacaagaccaacuacaaccccagccugaacggcagagugaccaugagccuggacaccagcaagaaccaguucagccugagacugaccagcaugaccgacgccgacaccgccaucuacuacugcgccagagagaagggccagugggugacccugccccccuacuacuucgacagcuggggccagggcauccuggugaccgugagcagcgccagcaccaagggc

SEQ ID NO: 34679 - RNA, 348 nt, Artificial Sequence
  derived and/or modified sequence opt4 from anti-HIV_Chain
ggccccgccacccugagcgugagccccggcgagagagccacccugagcugcagagccagccagagccugagaaacaaccuggccugguaccagcagaagaccggccagagccccagacugcugaucuacgccgugagcaccagagccaccggcaucccccccagauucagcggcggcggcagcggcaccgaguucacccugaccaucgacagccugcagagcgaggacuucgccguguacuucugccagcaguacgacagcccccaguggaccuucggccagggcaccaagguggagaucaagagaaccguggccgcccccagcguguucaucuucccccccagcgac

SEQ ID NO: 34680 - RNA, 348 nt, Artificial Sequence
  derived and/or modified sequence opt4 from anti-HIV_Chain
gcccccgugacccugagcgccagcgugggcgacaccgugaccaucaccugcagagccagccagcccaucgccaccuuccugaacugguaccagcacaagcccggccaggcccccaagcugcugaucuacgccgccagcaccuuccagagaggcgcccccagcagauacagcggcagcggcagcggcaccgacuucacccugaccaucaacagccugcagcccgaggaccuggccaccuacuacugccagcagaccuucaccgaccccgugaccuucggccagggcaccagacuggagaucaagagaaccguggccgcccccagcguguucaucuucccccccagcgac

SEQ ID NO: 34681 - RNA, 351 nt, Artificial Sequence
  derived and/or modified sequence opt4 from anti-HIV_LightChain
gacauccagaugacccagagccccagcacccugagcgccagcaucggcgacaccgugagaaucagcugcagagccagccagagcaucaccggcggcuggcuggccugguaccaccagagacccggcaaggcccccagacugcugaucuacagaggcagcagacugcugggcggcgugcccagcagauucagcggcagcgccgccggcaccgacuucacccugaccaucgccaaccugcaggccgaggacuucggcaccuucuacugccagcaguacgacaccuaccccggcaccuucggccagggcaccaagguggaggugaagagaaccguggccgcccccagcguguuc

SEQ ID NO: 34682 - RNA, 351 nt, Artificial Sequence
  derived and/or modified sequence opt4 from anti-HIV_LightChain
gacauccagaugacccagagccccagcacccugagcgccagcaucggcgacaccgugagaaucagcugcagagccagccagagcaucaccggcaacuggguggccugguaccagcagagacccggcaaggcccccagacugcugaucuacagaggcgccgcccugcugggcggcgugcccagcagauucagcggcagcgccgccggcaccgacuucacccugaccaucggcaaccugcagaccgaggacuucggcaccuucuacugccagcaguacgacaccuaccccggcaccuucggccagggcaccaagguggaggugaagagaaccguggccgcccccagcguguuc

SEQ ID NO: 34683 - RNA, 351 nt, Artificial Sequence
  derived and/or modified sequence opt4 from anti-HIV_LightChain
gacauccagaugacccagagccccagcacccugagcgccagcaucggcgacaccgugagaaucagcugcagagccagccagagcaucaccggcaacuggguggccugguaccagcagagacccggcaaggcccccagacugcugaucuacagaggcgccgcccugcugggcggcgugcccagcagauucagaggcagcgccgccggcaccgacuucacccugaccaucggcaaccugcaggccgaggacuucggcaccuucuacugccagcaguacgacaccuaccccggcaccuucggccagggcaccaagguggaggugaagagaaccguggccgcccccagcguguuc

SEQ ID NO: 34684 - RNA, 351 nt, Artificial Sequence
  derived and/or modified sequence opt4 from anti-HIV_LightChain
gacauccagaugacccagagccccagcacccugagcgccagcgugggcgacaccgugagaaucagcugcagagccagccagagcaucaccggcggcuggcuggccugguaccaccagagacccggcaaggcccccagacugcugaucuacagaggcagcagacugcugggcggcgugcccagcagauucagcggcagcgccgccggcaccgacuucacccugaccaucgccaaccugcaggccgaggacuucggcaccuucuacugccagcaguacgacaccuaccccggcaccuucggccagggcaccaagguggaggugaagagaaccguggccgcccccagcguguuc

SEQ ID NO: 34685 - RNA, 351 nt, Artificial Sequence
  derived and/or modified sequence opt4 from anti-HIV_LightChain
gacauccagaugacccagagccccagcacccugagcgccagcaucggcgacaccgugagaaucagcugcagagccagccagagcaucaccggcaacuggguggccugguaccagcagagacccggcaaggcccccagacugcugaucuacagaggcgccgcccugcugggcggcgugcccagcagauucagcggcagcgccgccggcaccgacuucacccugaccaucggcaaccugcaggccgaggacuucggcaccuucuacugccagcaguacgacaccuaccccggcaccuucggccagggcaccaagguggaggugaagagaaccguggccgcccccagcguguuc

SEQ ID NO: 34686 - RNA, 351 nt, Artificial Sequence
  derived and/or modified sequence opt4 from anti-HIV_LightChain
gacauccagaugacccagagccccagcacccugagcgccagcaucggcgacaccgugagaaucagcugcagagccagccagagcaucaccggcggcuggguggccugguaccaccagagacccggcaaggcccccagacugcugaucuacagaggcagcagacugcugggcggcgugcccagcagauucagcggcagcgccgccggcaccgacuucacccugaccaucggcaaccugcaggccgaggacuucggcaccuucuacugccagcaguacgacaccuaccccggcaccuucggccagggcaccaagguggaggugaagagaaccguggccgcccccagcguguuc

SEQ ID NO: 34687 - RNA, 351 nt, Artificial Sequence
  derived and/or modified sequence opt4 from anti-HIV_LightChain
gacauccagaugacccagagccccagcacccugagcgccagcgugggcgacaccgugagaaucagcugcagagccagccagagcaucaccggcggcuggcuggccugguaccaccagagacccggcaaggcccccagacugcugaucuacagaggcagcagacugcugggcggcgugcccagcagauucagcggcagcgccgccggcaccggcuucacccugaccaucgccaaccugcaggccgaggacuucggcaccuucuacugccagcaguacgacaccuaccccggcaccuucggccagggcaccaagguggaggugaagagaaccguggccgcccccagcguguuc

SEQ ID NO: 34688 - RNA, 351 nt, Artificial Sequence
  derived and/or modified sequence opt4 from anti-HIV_LightChain
gacauccagaugacccagagccccagcacccugagcgccagcgugggcggcaccgugagaaucagcugcagagccagccagagcaucaccggcggcuggcuggccugguaccaccagagacccggcaaggcccccagacugcugaucuacagaggcagcagacugcugggcggcgugcccagcagauucagcggcagcgccgccggcaccgacuucacccugaccaucgccaaccugcaggccgaggacuucggcaccuucuacugccagcaguacgacaccuaccccggcaccuucggccagggcaccaagguggaggugaagagaaccguggccgcccccagcguguuc

SEQ ID NO: 34689 - RNA, 351 nt, Artificial Sequence
  derived and/or modified sequence opt4 from anti-HIV_LightChain
gacauccagaugacccagagccccagcacccugagcgccagcaucggcgacaccgugagaaucagcugcagagccagccagagcaucaccggcaacuggguggccugguaccaccagagacccggcaaggcccccagacugcugaucuacagaggcgccgcccugcugggcggcgugcccagcagauucagcggcagcgccgccggcaccgacuucacccugaccaucggcaaccugcaggccgaggacuucggcaccuucuacugccagcaguacgacaccuaccccggcaccuucggccagggcaccaagguggaggugaagagaaccguggccgcccccagcguguuc

SEQ ID NO: 34690 - RNA, 351 nt, Artificial Sequence
  derived and/or modified sequence opt4 from anti-HIV_LightChain
gacauccagaugacccagagccccagcacccugagcgccagcaucggcgacaccgugaugaucagcugcagagccagccagagcaucaccggcggcuggcuggccugguaccaccagagacccggcaaggcccccagacugcugaucuacagaggcagcaagcugcugggcggcgugcccagcagauucagcggcagcgccgccggcaccggcuucacccugaccaucggcaaccugcaggccgaggacuucggcaccuucuacugccagcaguacgacaccuaccccggcaccuucggccagggcaccaagguggaggugaagagaaccguggccgcccccagcguguuc

SEQ ID NO: 34691 - RNA, 351 nt, Artificial Sequence
  derived and/or modified sequence opt4 from anti-HIV_LightChain
gacauccagaugacccagagccccagcacccugagcgccagcgugggcgacaccgugagaaucagcugcagagccagccagagcaucaccggcggcuggcuggccugguaccaccagagacccggcaaggcccccagacugcugaucuacagaggcagcagacugcugggcggcgugcccagcagauucagcggcagcgccgccggcgccgacuucacccugaccaucgccaaccugcaggccgaggacuucggcaccuucuacugccagcaguacgacaccuaccccggcaccuucggccagggcaccaagguggaggugaagagaaccguggccgcccccagcguguuc

SEQ ID NO: 34692 - RNA, 351 nt, Artificial Sequence
  derived and/or modified sequence opt4 from anti-HIV_LightChain
gacauccagaugacccagagccccagcacccugagcgccagcaucggcgacaccgugagaaucagcugcagagccagccagagcaucaccggcggcuggcuggccugguaccaccagagacccggcaaggcccccagacugcugaucuacagaggcagcagacuggugggcggcgugcccagcagauucagcggcagcgccgccggcaccgacuucacccugaccaucggcaaccugcaggccgaggacuucggcaccuucuacugccagcaguacgacaccuaccccggcaccuucggccagggcaccaagguggaggugaagagaaccguggccgcccccagcguguuc

SEQ ID NO: 34693 - RNA, 351 nt, Artificial Sequence
  derived and/or modified sequence opt4 from anti-HIV_LightChain
gacauccagaugacccagagccccagcacccugagcgccagcaucggcgacaccgugagaaucagcugcagagccagccagagcaucaccggcggcuggcuggccugguaccaccagagacccggcaaggcccccagacugcugaucuacagaggcagcagacugcugggcggcgugcccagcaaguucagcggcagcgccgccggcaccgacuucacccugaccaucgccaaccugcaggccgaggacuucggcaccuucuacugccagcaguacgacaccuaccccggcaccuucggccagggcaccaagguggaggugaagagaaccguggccgcccccagcguguuc

SEQ ID NO: 34694 - RNA, 351 nt, Artificial Sequence
  derived and/or modified sequence opt4 from anti-HIV_LightChain
gacauccagaugacccagagccccagcacccugagcgccagcaccggcgacaccgugagaaucagcugcagagccagccagagcaucaccggcaacuggguggccugguaccagcagagacccggcaaggcccccagacugcugaucuacagaggcgccgcccugcugggcggcgugcccagcagauucagaggcagcgccgccggcaccgacuucacccugaccaucggcaaccugcaggccgaggacuucggcaccuucuacugccagcaguacgacaccuaccccggcaccuucggccagggcaccaagguggaggugaagagaaccguggccgcccccagcguguuc

SEQ ID NO: 34695 - RNA, 351 nt, Artificial Sequence
  derived and/or modified sequence opt4 from anti-HIV_LightChain
gacauccagaugacccagagccccagcacccugagcgccagcaucggcgacaccgugagaaucagcugcagagccagccagagcaucaccggcaacuggcuggccugguaccaccagagacccggcaaggcccccagacugcugaucuacagaggcagcagacugcugggcggcgugcccagcagauucagcggcagcgccgccggcaccgacuucacccugaccaucgccaaccugcaggccgaggacuucggcaccuucuacugccagcaguacgacaccuaccccggcaccuucggccagggcaccaagguggaggugaagagaaccguggccgcccccagcguguuc

SEQ ID NO: 34696 - RNA, 351 nt, Artificial Sequence
  derived and/or modified sequence opt4 from anti-HIV_Chain
aucauccuguuccugguggccaccgccaccggcagcugggcccagagcgcccugacccagcccagaagcgugagcggcagccugggccagagcgugaccaucagcugcaccggcagcagcagcgacgugggcagauacaacuacgugagcugguaccagcaccaccccggcaaggcccccaagcugaugaucagcgacgugaacaagagacccagcggcgugcccgacagauucagcggcagcaagagcggcaacaccgccagccugaccaucagcggccugcaggccgaggacgagaccgacuacuacugcugcagcuacgccggcagcuacaucuggguguucggcggc

SEQ ID NO: 34697 - RNA, 351 nt, Artificial Sequence
  derived and/or modified sequence opt4 from anti-HIV_Chain
cccgugacccugagcgccagcgugggcgacagagugaccaucaccugcagagccagcgaggacaucagcaaguaccugaacugguaccagcacaagcccggcaaggcccccaagcugcugaucuacaccgccagcagccuggagaccggcgugcccagcagauucagcggcagcggcagcggcaccgacuucagccugaccaucagcagccugcagcccgacgacuucgccaccuacuacugccagcagagcuacaccagcagcgugaccuucggccagggcaccagaguggaggugaagagaaccguggccgcccccagcguguucaucuucccccccagcgacgagcag

SEQ ID NO: 34698 - RNA, 351 nt, Artificial Sequence
  derived and/or modified sequence opt4 from anti-HIV_Chain
guggaggagcccggcagcagcgugaaggugagcugcaaggccagcggcggcagcagcaccgccuacggcuacagcugggugagacaggcccccggccagggcuucgaguggaugggcagaaucauccccuucuacggcaucaucaccuacgcccccaaguuccagggcagagugaccaucaccgccgacagaagcaccagcaccguguacauggagcugaccagacugaccuucgccgacaccgcccuguucuucugcgccagagacuacggcgaccccagaaacggcuacuacuucgacagcugggaccagggccuguggcugaccgugagcagcgccagcaccaagggc

SEQ ID NO: 34699 - RNA, 351 nt, Artificial Sequence
  derived and/or modified sequence opt4 from anti-HIV_Chain
caggugagacuggagcagagcggcgccgccgugagaacccccggcgccagcgugacccugagcugccaggccagcggcuacaaguucgugaacuacaucauccacugggugagacagagacccggccuggccuucgagugggugggcaugaucgaccccuacagaggcagacccuggagcgcccacagcuucgagggcagacugagccugagcagagacgugagcauggagauccuguacaugacccugaccagccugagaagcgacgacaccgccaccuacuucugcgccagagccgaggccgagagccagagccacagcagacccaucaucagcaccagcggcgccaga

SEQ ID NO: 34700 - RNA, 351 nt, Artificial Sequence
  derived and/or modified sequence opt4 from anti-HIV_Chain
gugcaccuggaggugcagcugcagcagagcggccccgagcugaagaagcccggcgagaccgugaagaucagcugcaaggccagcguguacaccuucaccgaguaccccauccacugggugaagcaggcccccggcaagggcuucaaguggaugggcuggaucaacaccuacagcggcgagcccaccuacgccgacgacuucaagggcagauucgccuucagccuggagaccagcgccagcaccgccuaccugcagaucaacagccugaagaacgaggacaccgccaccuacuucugcgccagccugggcagagacuacuggggccagggccagggcaccacccugaccgug

SEQ ID NO: 34701 - RNA, 354 nt, Artificial Sequence
  derived and/or modified sequence opt4 from anti-HIV_Chain
cugagcgugagccugggcgagagagccaccaucaacugcaagagcagccagagcauccuguacagcagcgacaagaagaacuaccuggccugguaccagcagaagaucggccagccccccaagcugcugcuguacugggccagcaccagagagagcggcauccccgacagauucagcggcagcggcagcggcagcgacuucacccugaccaucagcagccugcagcccgaggacguggccguguacuacugccagcaguacuacaucagccccuucaccuucggccccggcaccaagguggaccugaagagaaccguggccgcccccagcguguucaucuucccccccagcgac

SEQ ID NO: 34702 - RNA, 354 nt, Artificial Sequence
  derived and/or modified sequence opt4 from anti-HIV_Chain
cagagcgugcugacccagccccccagcgccagcggcgcccccggccagagagugaccaucagcugcagcggcggccccagcaacgugggcggcaacuacguguacugguacagacaguuccccggcaccgcccccaagcugcugauccugagagacgaccagagacccagcggcgugcccgacagauucagcgccagcaagagcggcaacagcgccagccuggccaucagcggccugagacccgacgacgaggccuucuacuucugcgccaccuacgacagcgacggcagcaucagacuguucggcggcggcaccgcccugaccgugcugagccagcccaaggccgcccccagc

SEQ ID NO: 34703 - RNA, 354 nt, Artificial Sequence
  derived and/or modified sequence opt4 from anti-HIV_Chain
aaggcccccgccacccugagccugagccccggcgagagagccacccugagcugcagagccagccagagcgugggcagcgaccuggccugguaccagcagaagcccggccaggcccccagacugcugaucuacgacgccagcaacagagccaccgccauccccgccagauucagcggcagcggcagcggcaccgacuucacccugagcaucagcagccuggagcccgaggacuucgccguguacuucugccagcagagauacgacaagaucaccuucggccagggcaccagacuggagauccagagaaccguggccgcccccagcguguucaucuucccccccagcgacgagcag

SEQ ID NO: 34704 - RNA, 354 nt, Artificial Sequence
  derived and/or modified sequence opt4 from anti-HIV_Chain
caggugcagcuggugcagagcggcgccgaggccaagagacccggcgacagcgugaaggugagcugcaaggccagcggcuacaccuucaccgaguacuacauccacugggugagacagacccccggccagggcuucgaguggaugggcaucaucacccccggcgccggcaacaccaccuacgcccagaaguuccagggcagaaucaccgugaccagagacaccagcgccgccaccguguacauggagcugagcaaccugaccagcgaggacaccgccguguacuucugcagcagaggcgugagcuucuggggccagggcacccuggugaccgugagcagcgccagcaccaagggc

SEQ ID NO: 34705 - RNA, 354 nt, Artificial Sequence
  derived and/or modified sequence opt4 from anti-HIV_HeavyChain
gaggugaagcugcagcagagcggcgccgagcuggugagacccggcgccagcgugaagaugagcugcaaggccagcggcuacagauucaccagcuacaacaugcacugggugaagcagacccccagacagggccuggaguggaucggcgccaucuaccccggcaacggcgacaccagcuacaaccagaaguucaagggcaaggccacccugaccguggacaagagcagcagcaccgccuacaugcagcugagcagccugaccagcgaggacagcgccguguacuucugcgccagaggcagacugagccugggcuucgacuacuggggccagggcagcacccugaccgugagcagc

SEQ ID NO: 34706 - RNA, 357 nt, Artificial Sequence
  derived and/or modified sequence opt4 from anti-HIV_Chain
caggugcagcuggugcagagcggcaccgccgugaagagacccggcgccagcgugagagugagcugccaggccagcggcuacaccuucaucgaccacuucaucuacugguggagacaggcccccggccagggccuggaguggcugggcuggaucaacccccugaccagccagcccagcuaccccagcagauuccagggcagacugacccugaccagagacaccuucgacgagaugcuguacauggaccugagaggccugagaagcgacgacaccggcaucuacuucugcgccagaagacacagcgacuacugcgacuucgacaucuggggcagcggcacccagaucaucgugagcagc

SEQ ID NO: 34707 - RNA, 357 nt, Artificial Sequence
  derived and/or modified sequence opt4 from anti-HIV_Chain
caggugcagcuggugcagagcggcaccgccgugaagagacccggcgccagcgugagagugagcugccaggccagcggcuacaccuucaccgacuacuucaucuacugguggagacaggcccccggccagggccuggaguggcugggcuggaucaacccccugaccagccagcccagcuaccccagcagauuccagggcagacugacccugaccagagacaccuucgacgagaugcuguacauggaccugagaggccugagaagcgacgacaccggcaucuacuucugcgccagaagacacagcgacuacugcgacuucgacaucuggggcagcggcacccagaucaucgugagcagc

SEQ ID NO: 34708 - RNA, 357 nt, Artificial Sequence
  derived and/or modified sequence opt4 from anti-HIV_Chain
cagagcgugcugacccagcccagaagcgugagcggcagccccggccagagcgugaccaucagcugcaccggcaccagcagcgacgugggcggcuacaacuacgugagcugguaccagcagcaccccggcaaggcccccaagaccaugaucuucgacgugaccaagagacccagcggcgugcccgacagauucagcggcagcaagagcggcaacaccgccagccugaccaucagcggccugcaggccgaggacgaggccgacuacuacugcagcagcuacgccggcagaaacaccuucuacguguucggcaccggcaccaccgugaccgugcaggugagccccagccagccccccccc

SEQ ID NO: 34709 - RNA, 357 nt, Artificial Sequence
  derived and/or modified sequence opt4 from anti-HIV_Chain
gagaucgugcugacccagagccccggcacccugagccugagccccggcgagagagccacccugagcugcagagccagccagagcgugagcagcaacuaccuggccugguaccagcagaagcccggccaggcccccagacugcugaucuacggcgccagcagcagagccaccggcauccccgacagauucagcggcagcggcagcggcaccgacuucacccugagcaucagcagacuggagcccgaggacuucgccguguacuacugccagcaguacggcaccagcagcugcaccuucggccagggcaccaagcuggagaucaagagaaccguggccgcccccagcguguucaucuuc

SEQ ID NO: 34710 - RNA, 357 nt, Artificial Sequence
  derived and/or modified sequence opt4 from anti-HIV_Chain
cugagcgccagcgugggcgacagagugaccaucaccugcagagccagccagagcaucgacagauaccugaacugguaccagcagaagcccggcaaggcccccaagcugcugaucuacgccgccagcagccugcacaccgacgugcccagcagauucagcggcagcggcgccggcaccuacuucacccugaccaucaccagccugcagcccgaggacuucgccaccuacuacugccagcagagccacagccccagcuucggccaggagagcuacagcaucaccuucggccagggcaccagacuggagaucaagagaaccguggccgcccccagcguguucaucuucccccccagcgac

SEQ ID NO: 34711 - RNA, 357 nt, Artificial Sequence
  derived and/or modified sequence opt4 from anti-HIV_Chain
aacuucaugcugacccaggcccccagcgccagcggcgcccccggccagagagugaccaucagcugcagcggcggccccagcaacgugggcggcaacuacguguacugguacagacaguaccccggcaccgcccccaagcugcugauccugagagacgaccagagacccagcggcgugcccgacagauucagcgccagcaagagcggcaacagcgccagccuggccaucagcgagcugagacccgacgacgaggccuucuacuucugcgccaccuacgacagcgacggcagcaucagacuguucggcggcggcaccgcccugaccgugcugagccagcccaaggccgcccccagcgug

SEQ ID NO: 34712 - RNA, 360 nt, Artificial Sequence
  derived and/or modified sequence opt4 from anti-HIV_Chain
gacauccagaugacccagagccccagcagccugagcgccagcaucggcgacagagugaacaucaccugccaggccagcagagacaccggcagcgcccugaacugguaccagcagaaggugggcagaccccccagacugcugaucagcgccgugagcaaccugggcgccggcgugcccagcagauucagcggcagaagaagcggcacccagagcacccugaccaucaacacccugcagcccgaggacaucgccaccuacuucugccagcacuacgaguucuucggccccggcaccaagguggacaucaagagaaccguggccgcccccagcguguucaucuucccccccagcgacgagcag

SEQ ID NO: 34713 - RNA, 360 nt, Artificial Sequence
  derived and/or modified sequence opt4 from anti-HIV_Chain
cagagcgugcugacccagcccgccagcgugagcggcagccccggccagagcaucaccaucagcugcaccggcaccagcaacgacgugggcggccagaacuucgugagcugguaccagcagcaccccggcaccgccccccagcugcugaucuacgacgugaccaacagacccgccggcgugagcagcagauucagcggcagcaagagcggcaacaccgccagccugaccaucagcggccugagaaccgaggacgaggccgacuacuacugcgccagcuucaccauccugaacggcguggacuacguguucggcaccggcaccaaggugaccgugcugcugagccccagccagcccuaccug

SEQ ID NO: 34714 - RNA, 360 nt, Artificial Sequence
  derived and/or modified sequence opt4 from anti-HIV_Chain
aacuucaugcugacccagcccgccagcgugagcggcagccccggccagagcaucacccugagcugcaccggcaccaccagcgacgugagagacagcaacuucgugagcugguaccagcaggugcccggcaaggcccccaagcugaucaucuacgacgugagcgccagacccagcggcgugagcuucagauucagcggcagcaagagcggcaacaccgccagccugaccaucagcggccugcaggccgaggacgaggcccuguacuacugcagcagcuucacccccaccaacacccugguguucggcggcggcaccaagcugaccgugcugggccagcccaaggccgcccccagcgugacc

SEQ ID NO: 34715 - RNA, 360 nt, Artificial Sequence
  derived and/or modified sequence opt4 from anti-HIV_Chain
cagagcgcccugacccagccccccgccgccagcggcgcccccggccagagagugaccaucagcugcagcggcggcggcagcaacgugggcggcaaccuggugagcugguaccagcaguuccccggcgccgcccccaagcugauccugcacagagacggccagagacccagcggcgugcccgacagauucagcgccagcaagagcggcaccagcgccagccugaccaucagcggccugagaagcgacgacgaggccaccuacuucugcgccgccuacgacagcgccgugagccugcccguguucggcggcggcaccaagcugaccgugcugagccagcccaaggccgccccccuggugacc

SEQ ID NO: 34716 - RNA, 360 nt, Artificial Sequence
  derived and/or modified sequence opt4 from anti-HIV_Chain
cagcuggugcugacccagccccccagcgugagcggcacccccggccagaacgugaccaucagcugcagcggcggcggcagccacgugggcggcaaccuggugagcugguaccagcacuuccccggcgccgcccccaagcugcugauccacagagacaaccagagacccagcggcgugcccgacagauucagcgcccugaagagcggcaacagcgccagccuggccaucagcggccugagaagcgacgacgaggccuucuacuucugcgccguguacgacagcagccugagccugggccuguucggcggcggcaccaagcugaccgugcugagccagcccaaggccgcccccagcgugacc

SEQ ID NO: 34717 - RNA, 360 nt, Artificial Sequence
  derived and/or modified sequence opt4 from anti-HIV_Chain
gacauccagaugacccagagccccagcagccugagcgccagcgugggcgacagagugagcauccacugccaggccggccagggcaucggcagcagccugaagugguaccagcagaagagcggcagagcccccagacugcuggugcacggcgccagcaaccugcagagaggcgugcccagcagauucagcggcagcggcuuccacaccaccuucacccugaccaucagcagccugcagcccgacgacguggccaccuacuggugcgccgugcuggaguucuucggccccggcaccaagguggagaucaagagaaccguggccgcccccagcguguucaucuucccccccagcgacgagcag

SEQ ID NO: 34718 - RNA, 360 nt, Artificial Sequence
  derived and/or modified sequence opt4 from anti-HIV_Chain
gacauccagaugacccagagccccagcagccugagcgccagcgugggcgacagagugaccaucaccugccaggccagccagggcaucggcagcagccugcagugguaccagcagaagcccggcagagcccccaagcugcuggugcacggcgccagcaaccugcacagaggcgugcccagcagauucagcggcagcggcuuccacaccagcuucacccugaccaucagcagccugcagcccgacgacguggccaccuacuucugcgccgugcuggaguucuucggccccggcaccaagguggagaucaagagaaccguggccgcccccagcguguucaucuucccccccagcgacgagcag

SEQ ID NO: 34719 - RNA, 360 nt, Artificial Sequence
  derived and/or modified sequence opt4 from anti-HIV_Chain
gacauccagaugacccagagccccagcagccugagcgccagcgugggcgacagagugagcaucaacugccaggccggccagggcaucggcagcagccugaacugguaccagcagaagagaggcaaggcccccaagcugcuggugcacggcgccagcacccugcagagaggcgugcccagcagauucagcggcagcggcuuccacaccaccuucacccugaccaucagcagccugcagcccgacgacguggccaccuacuucugcgagagcuuccagugguucggccccggcaccaagguggagaucaagagaaccguggccgcccccagcguguucaucuucccccccagcgacgagcag

SEQ ID NO: 34720 - RNA, 360 nt, Artificial Sequence
  derived and/or modified sequence opt4 from anti-HIV_Chain
uacauccagaugacccagagccccagcagccugagcgccagcaucggcgacagagugaccaucaccugccaggccggccagggcaucggcagcagccugaacugguaccagcagaagcccggcaaggcccccaagcugcuggugcacggcgccagcaaccugcagagaggcgugagcagcagauucagcggcagcggcuuccacaccaccuucacccugaccaucagcagccugagacccgaggacgugggcaccuacuucugcgagguguacgaguucaucggccccggcaccaagguggacaucaagagaaccguggccgcccccagcguguucaucuucccccccagcgacgagcag

SEQ ID NO: 34721 - RNA, 360 nt, Artificial Sequence
  derived and/or modified sequence opt4 from anti-HIV_Chain
gacauccagaugacccagagccccagcagccugcccgccagcgugggcgacaccgugaccaucaccugccaggccggccagggcaucggcagcagccugcagugguaccagcagagacccggcagagcccccaaccugcugguguacgacgccagcaaccugcagagaggcgugcccagcagauucaccggcaccggcuuccacaccaccuucacccugaccaucagaggccugagacccgaggacuucggcaccuacuucugcgccagccuggaguucuucggccccggcaccaagguggacaucaagagaaccguggccgcccccagcguguucaucuucccccccagcgacgagcag

SEQ ID NO: 34722 - RNA, 360 nt, Artificial Sequence
  derived and/or modified sequence opt4 from anti-HIV_Chain
gacauccagaugacccagagccccagcagccugagcgccagcgugggcgacagagugaccaucaccugccaggccagccagggcaucggcagcagccugcagugguaccagcagaagcccggcagagcccccaaccugcuggugcacggcgccagcaaccugcacagaggcgugcccagcagauucagcggcagcggcuuccacaccaccuucagccugaccaucagcggccugcagagagacgacuucgccaccuacuucugcgccgugcuggaguucuucggccccggcaccaagguggacaucaagagaaccguggccgcccccagcguguucaucuucccccccagcgacgagcag

SEQ ID NO: 34723 - RNA, 360 nt, Artificial Sequence
  derived and/or modified sequence opt4 from anti-HIV_Chain
gacauccagaugacccagagccccagcagccugagcgugagcgugggcgacagagugagcaucaccugcagagccacccagggcaucggcaacagccugaacugguaccagcagaagcccggcaaggcccccaaggugcugaucuacggcaccaccaagcugcacggcggcgugcccagcagauucagcggcggcggcagcggcagcaccggcacccugaccaucgacagccugcagcccgaggacaucgccaccuacuucugccagcuguucgaguucuucggccccggcaccaagguggagaucaagagaaccguggccgcccccagcguguucaucuucccccccagcgacgagcag

SEQ ID NO: 34724 - RNA, 360 nt, Artificial Sequence
  derived and/or modified sequence opt4 from anti-HIV_Chain
gacauccagaugacccagagccccagcagccugagcgccagcgugggcgacagagugaccaucaccugccaggccggccagggcaucggcagcagccugaacugguaccagcagaagcccggcagagcccccaagcugcugguguacggcgccagcaaccugcagagaggcgugcccagcagauucagcggcagcggcuuccacaccaccuucacccugaccaucagcagccugcagcccgaggacuucgccaccuacuucugcagcguguacgaguuccugggccccggcaccaagguggagaucaagagaaccguggccgcccccagcguguucaucuucccccccagcgacgagcag

SEQ ID NO: 34725 - RNA, 360 nt, Artificial Sequence
  derived and/or modified sequence opt4 from anti-HIV_Chain
cccauguuccagcccggccagagcggcggcgugguggugcagagcggcgagagccugcaccugagcugcgaggccagcggcuucaaguucgccagccagaugaugcacugggugagacacgugcccggcagaggccuggaguggguggcccugaucagcugggacggcagcggcaagcuguucgccgacagcgugagaggcagauucaccauccacagauggaacgacagaaacagccuguaccuggacgugaagaacgugagacccgaggacgccgccaucuacuacugcaccagaaacggcuucgacguguggggccagggcauccuggugaccgugagcagcgccagcaccaagggc

SEQ ID NO: 34726 - RNA, 363 nt, Artificial Sequence
  derived and/or modified sequence opt4 from anti-HIV_HeavyChain
gaggugaagcugguggagagcggcggcggccuggugcagcccggcggcagccugagacugagcugcgccgccagcggcuucaccuucagcagcuucggcaugcacugggugagacaggcccccgagaagggccuggaguggguggccuacaucagcagcggcagcagcacccugcacuacgccgacaccgugaagggcagauucaccaucagcagagacaacagcaagaacagccuguaccugcagaugaaccugcugagagccgaggacaccgccguguacuacugcgccagaggcagcagaaaccugagccacagacugcugagcuacuggggccagggcacccuggugaccgugagcagc

SEQ ID NO: 34727 - RNA, 363 nt, Artificial Sequence
  derived and/or modified sequence opt4 from anti-HIV_HeavyChain
gaggugcagcugguggagagcggcggcggccuggugcagcccggcggcagccugagacugagcugcgccgccagcggcuucaccuucagcagcuucggcaugcacugggugagacaggcccccggcaagggccuggagugggugagcuacaucagcagcggcagcagcacccugcacuacgccgacaccgugaagggcagauucaccaucagcagagacaacagcaagaacagccuguaccugcagaugaacagccugagagccgaggacaccgccguguacuacugcgccagaggcagcagaaaccugagccacagacugcugagcuacuggggccagggcacccuggugaccgugagcagc

SEQ ID NO: 34728 - RNA, 363 nt, Artificial Sequence
  derived and/or modified sequence opt4 from anti-HIV_Chain
gacauccagaugacccagagccccagcagccugagcgccagcgugggcgacagagugaccaucaccugccaggccagccagggcaucagcaacagccugaacugguaccagcagaagcccggcaaggcccccagacugcugaucuacggcaccagcacccugcagagaggcgugcccagcagauucagcggcagcggcagcggcaccagauucaccgugaccaucaacagccugcagcccgaggacaucgccaccuacuucugccagcacaacgaguucuucggcagaggcaccaagguggacaucaagagaaccguggccgcccccagcguguucaucuucccccccagcgacgagcagcug

SEQ ID NO: 34729 - RNA, 363 nt, Artificial Sequence
  derived and/or modified sequence opt4 from anti-HIV_Chain
gacauccagaugacccagagccccagcagcgugagcgccagcgugggcgacagagugaccaucaccugccaggccagcagagacaccgacaacagccugaccugguaccagcagaagcccggcagaccccccaagcugcugaucuaccacguggugaaccugggccccggcgugcccagcagauucagcggcagcgccagcagcgccacccagagcacccugaucaucagcgacuuccagcccgacgacguggccaccuacuucugccagaacuacgaguucuucggccccggcaccaagguggagaucaagagaaccguggccgcccccagcguguucaucuucccccccagcgacgagcag

SEQ ID NO: 34730 - RNA, 363 nt, Artificial Sequence
  derived and/or modified sequence opt4 from anti-HIV_Chain
gagaucgugcugacccagagccccggcacccugagccugagccccggcgagagagccacccugagcugcagagccagccagagcgugagcagcaacaaccuggccugguaccagcagaagcccggccaggcccccagacugcugaugagcggcgccagcagcagagccaccggcauccccgacagauucagcggcagcggcagcggcaccgacuucacccugaccaucagcagacuggagcccgaggacuucgccguguaccacugccagcaguacggcagcagcccccccaccuucggccagggcaccaagguggagaucaagagaaccguggccgcccccagcguguucaucuuccccccc

SEQ ID NO: 34731 - RNA, 363 nt, Artificial Sequence
  derived and/or modified sequence opt4 from anti-HIV_Chain
gacauccagaugacccagagccccagcagccugagcgccuacgugggcgacagagugaccaucaccugcagagccagccagaacaucaacaccuaccugaacugguaccagcagagacccggcaaggcccccaagcugcugaucuacgccgccagcacccugcagagcggcgugcccagcagauucagcggcagcggcagcggcaccgacuucacccugaccaucagcaaccuggagaccgaggacuucgccguguacuacugccagcagaccuacagaagcgugaccuucggccagggcaccaagcuggagaucaagagaaccguggccgcccccagcguguucaucuucccccccagcgac

SEQ ID NO: 34732 - RNA, 363 nt, Artificial Sequence
  derived and/or modified sequence opt4 from anti-HIV_Chain
gacauccagaugacccagagccccagcagccugagcgccagcgugggcgacagagugaccaucaccugccaggccggccagggcaucggcagcagccugcagugguaccagcagaagcccggcaaggcccccaagcugcuggugcacggcgccagcaaccugcacagaggcgugcccagcagauucagcggcagcggcuuccacaccaccuucagccugaccaucagcggccugcagagagacgacuucgccaccuacuucugcgccgugguggaguucuucggccccggcaccaagguggacaucaagagaaccguggccgcccccagcguguucaucuucccccccagcgacgagcagcug

SEQ ID NO: 34733 - RNA, 363 nt, Artificial Sequence
  derived and/or modified sequence opt4 from anti-HIV_Chain
caggugcagcugguggagagcggcgccgagcugagaaagcccggcgagagccuggagaucagcugcaaggccagcggcuacagcuucagcagccacuggaucggcugggccagacagaugcccggcaagggccuggaguggaugggcaucaucuaccccggcgacagcaacaccaucuacagccccagcuuccagggccaggugaccaucagcgccgacaagagcaucaacaccgccuaccugcaguggagcagccugaaggccagcgacaccgccauguacuucugcgccagcaacuaccacgacuacuucuacuggggccagggcacccuggugaccgugagcagcgccagcaccaagggc

SEQ ID NO: 34734 - RNA, 363 nt, Artificial Sequence
  derived and/or modified sequence opt4 from anti-HIV_Chain
uucgugcagcugguggagagcggcggcggcguggugcagcccggcaccagccugagacugagcugcaccaccagcggcuucaucuucagcgacuacggcaugcacugggugagacaggccgccggcaagggccuggaguggguggccgugaucuggcacgacggcagcaacagauucuacgccgacagcgugaagggcagauucaccaucagcagagacaacagcaagaacgccguguaccuggagaugaacaaccugagaguggaggacaccgcccuguacuacugcgccagaaccagcauggacaucgacuacuggggccagggcacccccgugaccgugagcagcgccagcaccaagggc

SEQ ID NO: 34735 - RNA, 363 nt, Artificial Sequence
  derived and/or modified sequence opt4 from anti-HIV_Chain
gagcccauguuccagcccggccagagcggcggcgugguggugcagagcggcgagagccugcaccugagcugcgaggccagcggcuucaaguucgccagccagaugaugcacugggugagacacgugcccggcagaggccuggaguggguggcccugaucagcugggacggcagcggcaagcuguucgccgacagcgugagaggcagauucaccauccacagauggaacgacagaaacagccuguaccuggacgugaagaacgugagacccgaggacgccgccaucuacuacugcaccagaaacggcuucgacguguggggccagggcauccuggugaccgugagcagcgccagcaccaagggc

SEQ ID NO: 34736 - RNA, 366 nt, Artificial Sequence
  derived and/or modified sequence opt4 from anti-HIV_Chain
agccagcaccuggugcagagcggcacccaggugaagaagcccggcgccagcgugagaaucagcugccaggccagcggcuacagcuucaccgacuacgugcugcacugguggagacaggcccccggccagggccuggaguggaugggcuggaucaagcccguguacggcgccagaaacuacgccagaagauuccagggcagaaucaacuucgacagagacaucuacagagagaucgccuucauggaccugagcggccugagaagcgacgacaccgcccuguacuucugcgccagagacggcagcggcgacgacaccagcuggcaccuggaccccuggggccagggcacccuggugaucgugagcgcc

SEQ ID NO: 34737 - RNA, 366 nt, Artificial Sequence
  derived and/or modified sequence opt4 from anti-HIV_Chain
gacauccagaugacccagagccccagcagccugagcgccagcgugggcgacagagugaccaucaccugcagagccagccagagcaucagcagauaccugaacugguaccagcagaagcccggcaaggcccccaagcugcugaucuacgccgccagcagccugcagggcggcgugcccagcagauucagcggcagcggcagcggcaccgacuucacccugaccaucagcagccugcagcccgaggacuucgccaccuacuacugccagcagagcagcagcaagcccuucaccuucggcggcggcaccaagguggagaucaagagaaccguggccgcccccagcguguucaucuucccccccagcgac

SEQ ID NO: 34738 - RNA, 366 nt, Artificial Sequence
  derived and/or modified sequence opt4 from anti-HIV_Chain
gagaucgugcugacccagagccccggcacccugagccugagccccggcgagagagccacccugagcugcagagccagccagagcaucagcagcaacuaccuggccugguaccagcagaagcccggccaggcccccagacugcugaucuacggcgccagcaccagagccaccggcauccccgacagauucagcggcagcggcagcggcaccgacuucacccugagcaucagcagacuggagcccgaggacaucgccguguacuacugccaccaguacggcagcagccagagauucggccagggcaccaagguggagaucaagagaaccguggccgcccccagcguguucaucuucccccccagcgac

SEQ ID NO: 34739 - RNA, 366 nt, Artificial Sequence
  derived and/or modified sequence opt4 from anti-HIV_Chain
gagaucgugaugacccagagccccgccacccugagcgugagccccggcgacagagccacccugagcugcagagccagccagagcgugagcaccaaccuggccugguaccagcagaagcccggccaggcccccagacugcugaucuacggcgccagcaccagagccaccggcauccccgccaccuucagcggcagcggcuucgccaccgaguucacccugaccaucagcagccugcagagcgaggacuucgccguguacuacugccagcaguacaacaacuggccccccgccuucggccagggcaccaagguggagaucaagagaaccguggccgcccccagcguguucaucuucccccccagcgac

SEQ ID NO: 34740 - RNA, 366 nt, Artificial Sequence
  derived and/or modified sequence opt4 from anti-HIV_Chain
gacauccagaugacccagagccccgccagccugagcgccagcgugggcgacagagugaccaucaccugcagagccagccagggcaucagccacuaccuggccugguaccagcagaagcccggcaaggugcccagacugcugaucuacgccgccagcagacugcagagcggcgugaccagcagauucagcggcagcggcagcggcaccgaguucacccugaccaucagcagccugcugcccgaggacgccgccguguacuucugccagaaguacgacaccgaccccaugaccuucggccagggcaccagacuggagaucaagagaaccguggccgcccccagcguguucaucuucccccccagcgac

SEQ ID NO: 34741 - RNA, 366 nt, Artificial Sequence
  derived and/or modified sequence opt4 from anti-HIV_Chain
cagagcgcccugacccagccccccagcgccagcggcgcccccggccagagagugaccaucagcugcagcggcggccccagcaacgugggcggcaacuacguguacugguacagacaguuccccggcaccgcccccaaccugcugauccugagagacgaccagagacccagcggcgugcccgacagauucagcgccagcaagagcggcaacagcgccagccuggccaucagcggccugagacccgacgacgaggccuucuacuucugcgccaccuacgacagcgacggcagcaucagacuguucggcggcggcaccacccugaccgugcugagccagcccaaggccgcccccagcgugacccuguuc

SEQ ID NO: 34742 - RNA, 366 nt, Artificial Sequence
  derived and/or modified sequence opt4 from anti-HIV_Chain
gacauccagaugacccagagccccagcagccugagcgccagcgugggcgacagagugaccaucaacugccaggccggccagggcaucggcagcagccugaacugguaccagaagaagcccggcagagcccccaagcugcuggugcacggcgccagcaaccugcagagaggcgugcccagcagauucagcggcagcggcuuccacaccaccuucacccugaccaucagcagccugcagcccgacgacguggccaccuacuucugcgccguguuccagugguucggccccggcaccaagguggacaucaagagaaccguggccgcccccagcguguucaucuucccccccagcgacgagcagcugaag

SEQ ID NO: 34743 - RNA, 366 nt, Artificial Sequence
  derived and/or modified sequence opt4 from anti-HIV_Chain
gacauccagaugacccagagccccagcagccugagcgccagcgugggcgacagagugaccaucaccugccaggccagccagggcaucggcagcagccugcagugguaccagcagaagcccggcagagcccccaaccugcuggugcacggcgccagcaagcugcacagaggcgugcccagcagauucagcggcagcggcuuccacaccaccuucagccugaccaucagcggccugcagagagacgacuucgccaccuacuucugcgccgugcuggaguucuucggccccggcaccaagguggagaucaagagaaccguggccgcccccagcguguucaucuucccccccagcgacgagcagcugaag

SEQ ID NO: 34744 - RNA, 366 nt, Artificial Sequence
  derived and/or modified sequence opt4 from anti-HIV_Chain
caggugcaccuggugcagagcggcgccgaggugaagaagcccggcgccagcgugaaggugagcugcaaggugagcggcuacacccugagcgagcugagcauccacugggugagacagggccccggcagaggccuggaguggauggccaacuucgaccccgaggacggcgagaccaucuacgccccccaguuccagggcagagugacccugaccgaggacaccagcaccgacaccgccuacaugcagcugaccagccugagaagcgaggacaccgccguguacuacugcgccaccgacagauacaccgacaccggcagauggggccccggcacccuggugaccgugagcagcgccagcaccaagggc

SEQ ID NO: 34745 - RNA, 366 nt, Artificial Sequence
  derived and/or modified sequence opt4 from anti-HIV_Chain
caggugcagcugguggagagcggcggcggccugauccagcccggcggcagccugagacugagcugcgaggccagcggcuucgccgugggcgacaucaacuacaugagcugggugagacaggcccccggcaagggccuggagugggugagcgugcuguacagcggcggcagcagccaguacgccgacagcgugaagggcagauucaccaucagcagagacaacagcagaaacacccuguaccugcagauggacaaccugagagccgaggacaccgccguguacuacugcgccagaggccugagaguguacuucgaccuguggggccagggcauccuggugaccgugagcagcgccagcaccaagggc

SEQ ID NO: 34746 - RNA, 366 nt, Artificial Sequence
  derived and/or modified sequence opt4 from anti-HIV_Chain
caggugcagaugguggccagcggcggcggccuggugaagcccggcggcagccugagacugagcugcgaggccagcggcuucaccuucagcgacuacuacaugagcugggugagacaggcccccggcaagggccuggaguggaucagcuacaucaccagcggcggcaacgcccuguacuacgccgacagcgugaagggcagauucaccaucagcagagacaacgccaagaacagccuguaccugcagaugaacagccugagagccgaggacaccgccguguacuacugcgccagagaccugcugcacgcccacgacuucggcagacagggcacccuggugaccgugagcagcgccagcaccaagggc

SEQ ID NO: 34747 - RNA, 366 nt, Artificial Sequence
  derived and/or modified sequence opt4 from anti-HIV_Chain
cagcugcagcugguggagagcggcggcggcguggugcagcccggcagaagccugagacugagcugcgccgccagcggcuucaccuucagcaccuacaccaugcacugggugagacaggcccccggcaagggccuggaguggguggccgugaucagcuacgacggcaccaacaaguacuacgccgacagcgugaagggcagauucaccaucagcagagacaacagcaagaacacccuguaccugcagaugaacagccugagaggcgaggacaccgccguguacuacugcgccagaagccccagcuacuacuucgacuacuggggccagggcacccuggugaccgugagcgccgccagcaccaagggc

SEQ ID NO: 34748 - RNA, 369 nt, Artificial Sequence
  derived and/or modified sequence opt4 from anti-HIV_Chain
caggugcaccugagccagagcggcgccgccgugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagagugagccugaccagacaggccagcugggacuucgacaccuacagcuucuacauggaccugaaggccgugagaagcgacgacaccgccaucuacuucugcgccagacagagaagcgacuucugggacuucgacguguggggcagcggcacccaggugaccgugagcagc

SEQ ID NO: 34749 - RNA, 369 nt, Artificial Sequence
  derived and/or modified sequence opt4 from anti-HIV_Chain
caggugcagcugcugcagagcggcgccguggugaccaagcccggcgccagcgugagagugagcugcgaggccagcggcuacaagaucagagacuacuucauccacugguggagacaggcccccggccagggccugcagugggugggcuggaucaacccccagaccggccagcccaacauccccagacccuuccagggcagagugacccugaccagacacgccagcugggacuucgacaccuucagcuucuacauggaccugaaggcccugagaagcgacgacaccgccaucuacuucugcgccagaagaagaagcgacuacugcgacuucgacguguggggcagcggcacccacgugaccgugagcagc

SEQ ID NO: 34750 - RNA, 369 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacaguuccagggcagagugagccugaccagacacgccagcugggacuucgacaccuucagcuucuacauggaccugaagggccugagaagcgacgacaccgccaucuacuucugcgccagacagagaagcgacuacugggacuucgacguguggggcagcggcacccaggugaccgugagcagc

SEQ ID NO: 34751 - RNA, 369 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacuguuccagggcagagugagccugaccagacacgccagcugggacuucgacaccuucagcuucuacauggaccugaaggccgugagaagcgacgacaccgccguguacuucugcgccagacagagaagcgacuacugggacuucgacguguggggcagcggcacccaggugaccgugagcagc

SEQ ID NO: 34752 - RNA, 369 nt, Artificial Sequence
  derived and/or modified sequence opt4 from anti-HIV_Chain
caggugagacugcugcagagcggcgccgccgugaccaagcccggcgccagcgugagagugagcugcgaggccagcggcuacgagaucagagacuacuucauccacugguggagacaggcccccggccagggccugcagugggugggcuggaucaaccccaagaccggccagcccaacaaccccagacaguuccagggcagagugagccugaccagacaggccagcugggacuucgacagcuacagcuucuacauggaccugaaggcccugagaagcgacgacaccggcguguacuucugcgccagacagagaagcgacuacugggacuucgacguguggggcagcggcacccaggugaccgugagcagc

SEQ ID NO: 34753 - RNA, 369 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacaguuccagggcagagugagccugaccagacacgccagcugggacuucgacaccuucagcuucuacauggaccugaaggcccugagaagcgacgacaccgccguguacuucugcgccagacagagaagcgacuacugggacuucgacguguggggcagcggcacccaggugaccgugagcagc

SEQ ID NO: 34754 - RNA, 369 nt, Artificial Sequence
  derived and/or modified sequence opt4 from anti-HIV_Chain
gaggugcagcugguggagagcggcggcggccugauccagagaggcggcagccugagacugagcugcguggccagcggcuuccccgugagcgacaaccacaugagcugggugagacaggcccccggcaagggccuggagugggugagcaucaucuacagcgacggcggcaccuacuacgccgacagcgugaagggcagauucaccaucagcagagacaacagcaagaacaccguguaccugcagaugaacagccugagagccaccgacaccgccguguacuacugcgccagagaccccggcuuccacuacggccuggacguguggggccagggcaccaccgugaccgugagcagcgccagcaccaagggc

SEQ ID NO: 34755 - RNA, 369 nt, Artificial Sequence
  derived and/or modified sequence opt4 from anti-HIV_Chain
caggugcagcugcaggagagcggccccggccugcugagaccccuggagacccugagccugaccugcagcgugagcggcggcagcaucagaggcuacuucuggagcugggugagacagcccgccggcagaggccuggaguggaucggcagaaucuacagcagcggcaccaccagauucaaccccagccugaagagcagagugagacugagcaucgacaccgccaagagcgaggugagccugaacaucaccagcgugaccgccgccgacagcgccagcuacuucugcgccggcaccagccccgugcacggcggccuggaccuguggggccugggccugagagugaccgugagcagcgccagcaccaagggc

SEQ ID NO: 34756 - RNA, 369 nt, Artificial Sequence
  derived and/or modified sequence opt4 from anti-HIV_Chain
gagaucgugcugacccagagccccggcacccugagccugagccccggcgagagagccacccugagcugcagagccagccagagcgugagcagcaaccuggccugguacgcccagaagcccggccaggcccccagacugaucaucuacggcgccagcagcagagccagcgccauccccgacagauucagaggcagcggcagcggcaccgacuucacccugaccaucagcagacuggagcccgaggacuucgccguguacuacugccagcaguacgacgacgcccccaucaccuucggccacggcaccagacuggagaucaagagaaccguggccgcccccagcguguucaucuucccccccagcgacgag

SEQ ID NO: 34757 - RNA, 369 nt, Artificial Sequence
  derived and/or modified sequence opt4 from anti-HIV_Chain
gagaucgugcugacccagagccccggcacccugagccugagccccggcgacagagccgcccugagcugcagagccagcgagacccugagcggcaacagccuggccugguaccagcagaagagaggccagccccccagacugcugaucuucgccgccagcagcagagccaccggcauccccgagagauucagcggcggcggcagcggcaccgacuucacccugaccaucaccagacuggagcccgaggacuucgccguguacuucugccagcaguacguggacgcccccaucaccuucggccagggcaccagacuggagaucaagagaaccguggccgcccccagcguguucaucuucccccccagcgac

SEQ ID NO: 34758 - RNA, 369 nt, Artificial Sequence
  derived and/or modified sequence opt4 from anti-HIV_Chain
gacauccagaugacccagagccccagcagccugagcgccagcgugggcgacagagugaccaucaccugcagagccagccaggacaucaccaccuaccuggccuggcugcagcagaagcccggcaaggcccccaagagccugaucuacagcgccagcaccgugcagagcggcgugcccagcagauucagcggcagcggcagcggcaccgaguucacccugaccaucagcggccugcagcccgaggacuucgccaccuacuacugccagcaguacaacuacuaccccaucaccuucggccugggcaccagacuggagaucaagagaaccguggccgcccccagcguguucaucuucccccccagcgacgag

SEQ ID NO: 34759 - RNA, 369 nt, Artificial Sequence
  derived and/or modified sequence opt4 from anti-HIV_Chain
gacauccagaugacccagagccccagcagccugagcgccagcaucggcgacagagugaccaucaccugcagagccaaccagcacaucagaagcuuccugaacugguaccagcagacccccggcaaggcccccaagcugcugaucuacgccgccagcacccugcagagaggcgugcccagcagauucagcggcagcggcagcggcaccgacuucacccugaccaucaccagccuggagagagaggaccuggccaccuacuacugccagcagaccuacaccagccccaucaccuucggccagggcaccagacuggagaucaagagaaccguggccgcccccagcguguucaucuucccccccagcgacgag

SEQ ID NO: 34760 - RNA, 369 nt, Artificial Sequence
  derived and/or modified sequence opt4 from anti-HIV_Chain
agcgagaucgugcugacccagagccccgccacccugagccugagccccggcgagagcgccacccugagcugcagagccagccagagccugagcagcagccuggccugguaccagcagaagcccggccaggcccccagacugcugaucuacgacaccagcgacagagccaccggcauccccgccagauucagcggcagaggcagcggcaccgacuucacccugaccaucagcagccuggagcccgaggacuucgccguguacuacugccagcagagaagcaacugggccaucaccuucggccagggcaccagacuggagaucaagagaaccguggccgcccccagcguguucaucuucccccccagcgac

SEQ ID NO: 34761 - RNA, 369 nt, Artificial Sequence
  derived and/or modified sequence opt4 from anti-HIV_Chain
caggugcugagcgugagcggcacccccggccagagagugaucaucagcugcagcggcaccagcagcaacgugggcggcaaccuggugagcugguaccagcaccugcccggcgccgcccccagacugcugauccacagagacgaccagagacccagcggcgugcccgacagauucagcggcagcaagagcggcaacagcgccagccuggugaucagcggccugagaagcgacgacgaggccgacuacuucugcgccgccuacgacagcaccuucagccugcccguguucggcggcggcaccagacugaccgugcugagccagcccaaggccgcccccagcgugacccuguacgcccccagcagcgaggag

SEQ ID NO: 34762 - RNA, 369 nt, Artificial Sequence
  derived and/or modified sequence opt4 from anti-HIV_Chain
gacauccagaugacccagagccccagcagccugagcgccagcgugggcgacagagugaccaucaccugccaggccggccagggcaucggcagcagccugcagugguaccagcagaagcccggcaaggcccccaagcugcuggugcacggcgccagcaaccugcacagaggcgugcccagcagauucagcggcagcggcuuccacaccaccuucagccugaccaucagcggccugcagagagacgacuucgccaccuacuucugcgccgugcuggaguucuucggccccggcaccaagguggagaucaagagaaccguggccgcccccagcguguucaucuucccccccagcgacgagcagcugaagagc

SEQ ID NO: 34763 - RNA, 369 nt, Artificial Sequence
  derived and/or modified sequence opt4 from anti-HIV_Chain
gagaucgugcugacccagagccccgccacccugagccugagccccggcgagagagccacccugagcugcagagccagccagggccugaacuucguggugugguaccagcagaagagaggccaggcccccagacugcugauccacgcccccagcgacagagcccccggcgugcccgacagauucagcgccagaggcagcggcaccgacuucagccuggugaucagcagcguggagcccgacgacuucgccaucuacuacugccaggaguacagcagcacccccuacaacuucggccccggcaccagaguggacagaaagagaaccguggccgcccccagcguguucaucuucccccccagcgacgagcag

SEQ ID NO: 34764 - RNA, 369 nt, Artificial Sequence
  derived and/or modified sequence opt4 from anti-HIV_Chain
gagaucgugcugacccagagccccaccacccugagccugagccccggcgagagagccacccugagcugcagagccagccagggcgugaaccugguggugugguaccagcagaagagaggccaggcccccagacugcugaucuacggccccagcgacagagcccccggcgugcccgacagauucagcgccagaggcagcggcaccgaguucagccuggugaucagcagcguggagcccgacgacuucgcccuguacuacugccaggaguacagcagcacccccuacaacuucggcaccggcaccagaguggacagaaagagaaccguggccgcccccagcguguucaucuucccccccagcgacgagcag

SEQ ID NO: 34765 - RNA, 369 nt, Artificial Sequence
  derived and/or modified sequence opt4 from anti-HIV_Chain
gagaucgugcugacccagagccccgccacccugagccugagccccggcgagagagccacccugagcugcagagccagccagggcgugaacuucguggugugguaccagcagaagagaggccaggcccccagacugcugaucuacggccccagcaacagagcccccggcgugcccgacagauucagcgccagaggcagcggcaccgaguucagccuggugaucagcagcguggagcccgacgacuucgcccuguacuacugccaggaguacagcagcacccccuacaacuucggccccggcaccagaguggacagaaagagaaccguggccgcccccagcguguucaucuucccccccagcgacgagcag

SEQ ID NO: 34766 - RNA, 369 nt, Artificial Sequence
  derived and/or modified sequence opt4 from anti-HIV_Chain
gagaucgugcugacccagagccccgccacccugagccugagccccggcgagagagccacccugagcugcagagccagccagggccugaacuucguggugugguaccagcagaagagaggccaggcccccagacugcugauccacggccccagccacagagcccccggcgugcccgacagauucagcgccagaggcagcggcaccgaguucagccuggugaucagcagcguggagcccgacgacuucgccaucuacuacugccaggaguacagcagcacccccuacaacuucggccccggcaccagaguggacagaaagagaaccguggccgcccccagcguguucaucuucccccccagcgacgagcag

SEQ ID NO: 34767 - RNA, 369 nt, Artificial Sequence
  derived and/or modified sequence opt4 from anti-HIV_Chain
gagaucgugcugacccagagccccgccacccugagccugagccccggcgagagagccacccugagcugcagagccagccagggccugaacuucguggugugguaccagcagaagggcggccaggcccccagacugcugauccacggccccaccgacagagcccccggcgugcccgacagauucagcgccagaggcagcggcaccgaguucagccuggugaucagcagcguggagcccgacgacuucgcccuguacuacugccaggaguacagcagcacccccuacaacuucggccccggcaccagaguggacagaaagagaaccguggccgcccccagcguguucaucuucccccccagcgacgagcag

SEQ ID NO: 34768 - RNA, 369 nt, Artificial Sequence
  derived and/or modified sequence opt4 from anti-HIV_Chain
gagaucgugcugacccagagccccgccacccugagccugagccccggcgagagagccacccugagcugcagagccagccagggccugaacuucguggugugguaccagcagaagagaggccaggcccccagacugcugauccacgcccccagcggcagagcccccggcgugcccgacagauucagcgccagaggcagcggcaccgaguucagccuggugaucagcagcguggagcccgacgacuucgccaucuacuacugccaggaguacagcagcacccccuacaacuucggccccggcaccagaguggacagaaagagaaccguggccgcccccagcguguucaucuucccccccagcgacgagcag

SEQ ID NO: 34769 - RNA, 369 nt, Artificial Sequence
  derived and/or modified sequence opt4 from anti-HIV_Chain
caggugcagcuggugcagagcggcgccgaggugaagaagcccggcagcagcgugaaggugagcugcaagaccagcggcggcagcuucagcaacuacgccuucagcugggugagacaggcccccggcgagggccuggaguggaugggcagaaucauccccaucuucggcaccgccaaguacacccagaagcugcagggcagagugaccaucaccgccgacaaguucaccagcaccguguacauggagcugagcagccugagaagcgaggacaccgccaucuacuacugcgccagccugcaccagggccccaucggcuacacccccuggcaccccccccccagagccccccugggccagagcgugugcggc

SEQ ID NO: 34770 - RNA, 369 nt, Artificial Sequence
  derived and/or modified sequence opt4 from anti-HIV_Chain
caggugcagcugguggagagcggcggcggccuggugcagcccggcggcagccugagaaucagcugcagcgccaccggcuucaccuucagcacccacgccaugcacugggugagacaggcccccggcaagggccuggaguacgugagcgccaucaacagcaacggcagaagcgccuucuacgccgacagcgugaagggcagagugaccaucagcagagacaacagcaagaacacccuguuccugcagaugaccagccugagagccgaggacaccgccguguacuacugcgugaagggcccccugcugagauaccuggacagcuggggccagggcacccuggugaccgugagcagcgccagcaccaagggc

SEQ ID NO: 34771 - RNA, 369 nt, Artificial Sequence
  derived and/or modified sequence opt4 from anti-HIV_Chain
gaggugcagcugguggagagcggcggcggccuggugcagcccggcggcagccugagaaucagcugcagcgccaccggcuucaccuucagcacccacgccaugcacugggugagacaggcccccggcaagggccuggaguacgugagcgccaucaacagcaacggcagaagcgccuucuacgccgacagcgugaagggcagagugaccaucagcagagacaacagcaagaacacccuguuccugcagaugaccagccugagagccgaggacaccgccguguacuacugcgugaagggcccccugcugagauaccuggacagcuggggccagggcacccuggugaccgugagcagcgccagcaccaagggc

SEQ ID NO: 34772 - RNA, 369 nt, Artificial Sequence
  derived and/or modified sequence opt4 from anti-HIV_Chain
gaggagagcggccccggccuggugaagcccagccagacccugagccugaccugcagcgugagcggcgacagcgugagcagcggcggcuacuucuggagcuggaucagacagcaccccaccaagggccuggagugccugggcuacguguacuacaccggcaacaccuacuacaaccccagccugaagagcccccccaccaucgagguggccauggccaacaaccaggugagccugaagcugggcagcgugaccgccgccgacaccgccguguacuacugcgccagaaucaagagauucagaggcggcaacuacuucgacaccuggggccacggccugcuggugaccgugagcagcgccagcaccaagggc

SEQ ID NO: 34773 - RNA, 369 nt, Artificial Sequence
  derived and/or modified sequence opt4 from anti-HIV_Chain
caggugcagcugcaggagagcggcagcggccuggugaagcccagcggcacccugagccugaccugcgccgugagcaacggccccaucagcagcggcaacugguggagcugggugagacagacccccgagaagggccuggaguggaucggcgagguguaccacagcggcagcaccaaccacaaccccagccugaagagcagagccaccauccugguggacaagagcaagaaccaguucagccugaaccugagaagcgugaccgccgccgacaccgccguguacuacugcgccagagugagaggcagcuggaacuucgacuacuggggccagggcauccuggugaccgugagcagcgccagcaccaagggc

SEQ ID NO: 34774 - RNA, 369 nt, Artificial Sequence
  derived and/or modified sequence opt4 from anti-HIV_HeavyChain
gaggugcagcugcagcagagcggcaccgugcuggccagacccggcgccagcgugaagaugagcugcaaggccagcggcuacaccuucaccagcuacuggaugcacugggugaagcagagacccggccagggccuggaguggaucggcgccaucuaccccggcaacagcgacaccagcuacaaccagaaguucaagggcaaggccaagcugaccgccgugaccagcgccagcaccgccuacauggagcugagcagccugaccaacgaggacagcgccguguacuacugcaccagauggccccacuacuacggcggcagcagauacuacuucgacuacuggggccagggcaccacccugaccgugagcagc

SEQ ID NO: 34775 - RNA, 372 nt, Artificial Sequence
  derived and/or modified sequence opt4 from anti-HIV_Chain
guggugcagcugguggagagcggcggcggccuggugcagcccggcggcagccugagacugagcugcgccgccagcggcuucgccuucagaagcuacuggaugagcugggugagacaggcccccggcagaggccuggaguggguggccaacaucaagcaggacggcagcgagaaguacuacgccgacagcgugaagggcagauucaccaucagcagagacaacaccaagaacagccuguaccugcagaugaacagccugagagccgaggacaccgccguguucuacugcgccagcagaggcgacagauacggccccaucgacuacuggggccagggcacccuggugaccgugagcagcgccagcaccaagggc

SEQ ID NO: 34776 - RNA, 372 nt, Artificial Sequence
  derived and/or modified sequence opt4 from anti-HIV_Chain
caggugcagcuggugcagagcggcgccgagaucaagaagcccggcgagagccugaagaucagcugcaaggccagcggcuacaccuucaacgacuacuggaucggcugggugagacagaugcccggcaagggccuggaguggaugggcaucuucuaccccgacgacagcgacagcaacuacagccccagcuuccagggcagagugaccaucagcgccgacaagagcaucaccaccgccuaccugcaguggagcacccugaaggccagcgacagcgccauguacuucugcgccagacugcugggcgacagcggcgccuucgacaucuggggccagggcaccauggugaucgugagcagcgccagcaccaagggc

SEQ ID NO: 34777 - RNA, 372 nt, Artificial Sequence
  derived and/or modified sequence opt4 from anti-HIV_Chain
caggugcagcuggugcagagcggcggcggccuggugaagcccggcggcagccugagacugagcugcgccgccagcggcuucaccuucagcagcuacagcaugaacugggugagacaggcccccggcaagggccuggagugggugagcagcaucagcagcagcagcagcuacaucuacuacgccgacagcgugaagggcagauucaccaucagcagagacaacgccaagaacagccuguaccugcagaugaacagccugagagccgaggacaccgccguguacuacugcgccagagagggcagcuacuacuacggcauggacguguggggccagggcaccaccgugaccgugagcagcgccagcaccaagggc

SEQ ID NO: 34778 - RNA, 372 nt, Artificial Sequence
  derived and/or modified sequence opt4 from anti-HIV_Chain
gagaucgugcugacccagagccccgccacccugagcgugagccccggcgagagagccacccugagcugcagagccggccagagcgugagcagcgaccuggccugguaccagcacaagcccggccaggcccccagacugcugaucuacgacgccagcaagagagccaccggcauccccgccagauucagcggcagcggcagcggcaccgacuucacccugaccaucagcagccuggagcccgaggacuucgccguguacuacugccagcacagaaccaacuggccccccagcaucaccuucggccagggcaccagacuggagaucaagagaaccguggccgcccccagcguguucaucuucccccccagcgac

SEQ ID NO: 34779 - RNA, 372 nt, Artificial Sequence
  derived and/or modified sequence opt4 from anti-HIV_Chain
gagaucgugcugacccagagccccggcacccugagccugagccccggcgagagagccacccugagcugcagagccagccagagcgugagcagcagauaccuggccugguaccagcagaagcccggccaggcccccagacugaucaucuacgacgccagcagcagagccagcggcauccccgacagauucagcggcagcggcagcgagaccgacuucacccugaccaucaccagacuggagcccgaggacuucgccguguacuacugccagcuguacggcaccagccccaaguucaccuucggccagggcaccaagcuggagaucaagagaaccguggccgcccccagcguguucaucuucccccccagcgac

SEQ ID NO: 34780 - RNA, 372 nt, Artificial Sequence
  derived and/or modified sequence opt4 from anti-HIV_Chain
gagaucgugcugacccagagccccggcacccugagccugagccccggcgagagagccacccugagcugcagagccagccagagcgugagcaacaacuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacgccaccagcagccuguacaccuucggccagggcaccaagcuggagaucaagagaaccguggccgcccccagcguguucaucuucccccccagcgac

SEQ ID NO: 34781 - RNA, 372 nt, Artificial Sequence
  derived and/or modified sequence opt4 from anti-HIV_Chain
cccgccacccuggccgugagccccggcgagagagccaccaucagcugcaagagcagccagaaccugcuguacagcgccaacaaccagcacagccuggccugguaccagcagagacccggccagccccccaagcugcugcuguacugggccagcaccagacugagcggcgugcccgacagauucagcggcagcggcagcggcaccgacuucacccugaccaucagcaaccugcaggccgaggacguggccguguacuacugccagcaguacuacagccccccccccaccuucggccagggcaccaagguggagaucagaagaaccguggccgcccccagcguguucaucuucccccccagcgacgagcagcug

SEQ ID NO: 34782 - RNA, 372 nt, Artificial Sequence
  derived and/or modified sequence opt4 from anti-HIV_Chain
cagcccgugcugacccagccccccagcgccagcggcgcccccggccagagagugaccaucagcugcagcggcggccccagcaacgugggcggcaacuacguguacugguacagacaguuccccggcaccgcccccaaccugcugauccugagagacgaccagagacccagcggcgugcccgacagauucagcgccagcaagagcggcaacagcgccagccuggccaucaccggccugagacccgacgacgaggccuucuacuucugcgccaccuacgacagcgacggcagcaucagacuguucggcggcggcaccgcccugaccgugcugagccagcccaaggccgcccccagcgugacccuguuccccccc

SEQ ID NO: 34783 - RNA, 372 nt, Artificial Sequence
  derived and/or modified sequence opt4 from anti-HIV_Chain
aacuucaugcugacccagccccccagcgccagcggcgcccccggccagagagugaccaucagcugcagcggcggccccagcaacgugggcggcaacuacguguacugguacagacaguuccccggcaccgcccccaaccugcugauccugagagacgaccagagacccagcggcgugcccgacagauucagcgccagcaagagcggcaacagcgccagccuggccaucagcggccugagacccgacgacgaggccuucuacuucugcgccaccuacgacagcgacggcagcaucagacuguucggcggcggcaccacccugaccgugcugagccagcccaaggccgcccccagcgugacccuguuccccccc

SEQ ID NO: 34784 - RNA, 372 nt, Artificial Sequence
  derived and/or modified sequence opt4 from anti-HIV_Chain
gacauccagaugacccagagcccccccagccugagcgccagcgugggcgacagagugaccaucaccugccaggccagccaggacaucaacaacuuccugaacugguaccagcagaagcccggcaaggcccccagacugcugaucuacgacgccagcaaccuggagagcggcgugagcagcagauucagcggcagcagaagcggcaccgacuucacccugaccaucagcagccugcugcccgaggacaucgccaccuacagcugccagcaguacagcaaccugcccuacaccuucagccagggcaccaagcuggagaucaagagaaccguggccgcccccagcguguucaucuucccccccagcgacgagcag

SEQ ID NO: 34785 - RNA, 372 nt, Artificial Sequence
  derived and/or modified sequence opt4 from anti-HIV_Chain
caggugcagcuggugcagagcggcaccgccgugaagagacccggcgccagcgugagagugagcugccaggccagcggcuacaccuucaucgaccacuucaucuacugguggagacaggcccccggccagggccuggaguggcugggcuggaucaacccccugaccagccagcccagcuaccccagcagauuccagggcagacugacccugaccagagacaccuucgacgagaugcuguacauggaccugagaggccugagaagcgacgacaccggcaucuacuucugcgccagaagacacagcgacuacugcgacuucgacaucuggggcagcggcacccagaucaucgugagcagcgccagcaccaagggc

SEQ ID NO: 34786 - RNA, 372 nt, Artificial Sequence
  derived and/or modified sequence opt4 from anti-HIV_Chain
caggugcagcuggugcagagcggcgccgcccugaagaagcccggcgccagccugagaaucagcugccaggccuacggcuacaaguucaccgaccaccugaucuacugguggagacaggcccccggccagggccuggaguggaucggcuggaucaagcccgagaccggccagcccagcuacagcuacaaguuccagggcagagugagccugaccagagacaccuuccaggagauccuguucauggaccugagaggccugagaagcgacgacaccgccaucuacuucugcgccagaagacacagcgacuacugcgacuucgacguguggggcagcggcagccaggugaucgugagcagcgccagcaccaagggc

SEQ ID NO: 34787 - RNA, 372 nt, Artificial Sequence
  derived and/or modified sequence opt4 from anti-HIV_Chain
caggugcagcuggugcagagcggcgccgcccugaagaagcccggcgccagccugagaaucagcugccagaccuacggcuacaaguucaccgaccaccugaucuacugguggagacaggcccccggccagggccuggaguggaugggcuggaucaagcccgagaccggccagcccagcuacagcuacagauuccagggcagagugagccugaccagagacaccuucgaggagaucguguucauggaccugagaggccugagaagcgacgacaccgccaucuacuucugcgccagaagacacagcgacuacugcgacuucgacguguggggcagcggcagccaggugaucgugagcagcgccagcaccaagggc

SEQ ID NO: 34788 - RNA, 372 nt, Artificial Sequence
  derived and/or modified sequence opt4 from anti-HIV_Chain
caggugcagcuggugcagagcggcgccgcccugaagaagcccggcgccagccugagaaucagcugccagaccuacggcuacaaguucaccgaccaccugaucuacugguggagacaggcccccggccagggccuggaguggaucggcuggaucaagcccgagaccggccagcccagcuacagcuacagauuccagggcagagugagccugaccagagacaccuucgaggagaucgccuucauggaccugagaggccugagaagcgacgacaccgccaucuacuucugcgccagaagacacaccgacuacugcguguucgacguguggggcagcggcagccagaucaucgugagcagcgccagcaccaagggc

SEQ ID NO: 34789 - RNA, 372 nt, Artificial Sequence
  derived and/or modified sequence opt4 from anti-HIV_Chain
caggugcagcuggugcagagcggcaccgccgugaagagacccggcgccagcgugagagugagcugccaggccagcggcuacaccuucaccgacuacuucaucuacugguggagacaggcccccggccagggccuggaguggcugggcuggaucaacccccugaccagccagcccagcuaccccagcagauuccagggcagacugacccugaccagagacaccuucgacgagaugcuguacauggaccugagaggccugagaagcgacgacaccggcaucuacuucugcgccagaagacacagcgacuacugcgacuucgacaucuggggcagcggcacccagaucaucgugagcagcgccagcaccaagggc

SEQ ID NO: 34790 - RNA, 372 nt, Artificial Sequence
  derived and/or modified sequence opt4 from anti-HIV_Chain
caggugcagcuggugcagagcggcgccgcccugaagaagcccggcgccagcgugagaaucagcugccaggccuacggcuacaaguucaccgaccaccugaucuacugguggagacaggcccccggccagggccuggaguggaucggcuggaucaagcccgagaccggccagcccagcuacgccuacaaguuccagggcagagugacccugaccagagacaccuucgaggagauccacuucauggaccugagaggcgugagaaacgacgacaccgccaccuacuucugcgccagaagacacagcgacuacugcgacuucgacguguggggcagcggcagccaggugaucgugagcagcgccagcaccaagggc

SEQ ID NO: 34791 - RNA, 372 nt, Artificial Sequence
  derived and/or modified sequence opt4 from anti-HIV_Chain
caggugcagcuggugcagagcggcgccgcccugaagaagcccggcgccagcgugagaaucagcugccagaccuacggcuacaaguucaccgaccaccugaucuacugguggagacaggcccccggccagggccuggaguggaucggcuggaucaagcccgagaccggccagcccagcuacagcuacagauuccagggcagagugagccugaccagagacaccuucgaggagaucguguucauggaccugagaggccugagaagcgacgacaccgccaucuacuucugcgccagaagacacagcgacuacugcgacuucgacguguggggcagcggcagccaggugcuggugagcagcgccagcaccaagggc

SEQ ID NO: 34792 - RNA, 372 nt, Artificial Sequence
  derived and/or modified sequence opt4 from anti-HIV_Chain
caggugcagcuggugcagagcggcgccgcccugaagaagcccggcgccagccugagaaucagcugccagaccuacggcuacaaguucaccgaccaccugaucuacugguggagacaggcccccggccagggccuggaguggaucggcuggaucaagcccgagaccggccagcccagcuacagcuacagauuccagggcagagugagccugaccagagacaccuucgaggagaucguguucauggaccugagaggccugagaagcgacgacaccgccaucuacuucugcgccagaagacacagcgacuacugcgacuucgacguguggggcagcggcagccaggugcuggugagcagcgccagcaccaagggc

SEQ ID NO: 34793 - RNA, 372 nt, Artificial Sequence
  derived and/or modified sequence opt4 from anti-HIV_Chain
caggugcagcuggugcagagcggcgccgcccugaagaagcccggcgccagcgugagaaucagcugccagaccuacggcuacaaguucaccgaccaccugauccacugguggagacaggcccccggccagggccuggaguggaucggcuggaucaagcccgacaccggccagcccagcuacagcagcagauuccagggcagagugagccugaccagagacaccuucgaggagaucguguucauggaccugagaggccugagaagcgacgacaccgccaucuacuucugcgccagaagacacagcgacuacugcgacuucgacguguggggcagcggcagccaggugcuggugagcagcgccagcaccaagggc

SEQ ID NO: 34794 - RNA, 372 nt, Artificial Sequence
  derived and/or modified sequence opt4 from anti-HIV_Chain
caggugcagcuggugcagagcggcgccgcccugaagaagcccggcgccagccugagaaucagcugccagaccuacggcuacaaguucaccgaccaccugaucuacugguggagacaggcccccggccagggccuggaguggaucggcuggaucaagcccgagaccggccagcccagcuacagcuacagauuccagggcagagugagccugaccagagacaccuucgaggagaucguguucauggaccugagaggccugagaagcgacgacaccgccaucuacuucugcgccagaagacacagcgacuacugcgacuucgacguguggggcagcggcagccaggugaucgugagcagcgccagcaccaagggc

SEQ ID NO: 34795 - RNA, 372 nt, Artificial Sequence
  derived and/or modified sequence opt4 from anti-HIV_Chain
caggugcagcuggugcagagcggcgccgcccugaagaagcccggcgccagccugagaaucagcugccagaccuacggcuacaaguucaccgaccaccugaucuacugguggagacaggcccccggccagggccuggaguggaucggcuggaucaagcccgagaccggccagcccagcuacagcuacagauuccagggcagagugagccugaccagagacaccuucgaggagaucguguucauggaccugagaggccugagaagcgacgacaccgccaucuacuucugcgccagaagacacagcgacuacugcgacuucgacguguggggcggcggcagccaggugaucgugagcagcgccagcaccaagggc

SEQ ID NO: 34796 - RNA, 372 nt, Artificial Sequence
  derived and/or modified sequence opt4 from anti-HIV_Chain
caggugcagcuggugcagagcggcgccgcccugaagaagcccggcgccagccugagaaucagcugccugaccuacggcuacaaguucaccgaccaccugaucuacugguggagacaggcccccggccagggccuggaguggaucggcuggaucaagcccgagaccggccagcccagcuacagcuacagauuccagggcagagugagccugaccagagacaccuucgaggagaucguguucauggaccugagaggccugagaagcgacgacaccgccaucuacuucugcgccagaagacacagcgacuacugcgacuucgacguguggggcagcggcagccaggugaucgugagcagcgccagcaccaagggc

SEQ ID NO: 34797 - RNA, 372 nt, Artificial Sequence
  derived and/or modified sequence opt4 from anti-HIV_Chain
caggugcagcuggugcagagcggcgccacccugaagaagcccggcgccagcgugagaaucagcugccaggccuacggcuacaaguucaccgaccaccugauccacugguggagacaggcccccggccagggccuggaguggaucggcuggaucaagcccgagaccggccagcccagcuacgccuacaaguuccagggcagagugagccugaccagagacaccuucgaggagauccuguucauggaccugagaggccugagaagcgacgacaccgccaucuacuucugcgccagaagacacagcgacuacugcgaccuggacguguggggcggcggcacccagcugcuggugagcagcgccagcaccaagggc

SEQ ID NO: 34798 - RNA, 372 nt, Artificial Sequence
  derived and/or modified sequence opt4 from anti-HIV_Chain
caggugcagcuggugcagagcggcgccgcccugaagaagcccggcgccagcgugagaaucagcugccaggccuacggcuacaaguucaccgaccaccugaucuacugguggagacaggcccccggccagggccuggaguggaucggcuggaucaagcccgagaccggccagcccagcuacagcuacaaguuccagggcagagugacccugaccagagacaccuucgaggagauccacuucauggaccugagaggccugagauacgacgacaccgccaccuacuucugcgccagaagacacagcgacuacugcgacuucgacguguggggcagcggcagccaggugagcgugagcagcgccagcaccaagggc

SEQ ID NO: 34799 - RNA, 372 nt, Artificial Sequence
  derived and/or modified sequence opt4 from anti-HIV_Chain
caggugcagcuggugcagagcggcgccgcccugaagaagcccggcgccagccugagaaucagcugccaggccuacggcuacaaguucaccgaccaccugaucuacugguggagacaggcccccggccagggccuggaguggaucggcuggaucaagcccgagaccggccagcccagcuacagcuacaaguuccagggcagagugagccugaccagagacaccuuccaggagauccuguucaugaaccugagaggccugagaagcgacgacaccgccaucuacuucugcgccagaagacacagcgacuacugcgacuucgacguguggggcagcggcagccagauccuggugagcagcgccagcaccaagggc

SEQ ID NO: 34800 - RNA, 372 nt, Artificial Sequence
  derived and/or modified sequence opt4 from anti-HIV_Chain
caggugcagcuggugcagagcggcaccgccgugaagaagcccggcgccagcgugagagugagcugccaggccagcggcuacaccuucaccgacuacuucaucuacugguggagacaggcccccggccagggccuggaguggcugggcuggaucaaccccagaaccagccagcccagcuaccccuacagauuccagggcagagugacccugaccagagacaucuucgaggagaugcuguacauggaccugagaggccugagaagcgacgacaccggcaucuacuucugcgccagaagacacagcgacuacugcgacuucgacaucuggggcagcggcacccagaucaucgugagcagcgccagcaccaagggc

SEQ ID NO: 34801 - RNA, 372 nt, Artificial Sequence
  derived and/or modified sequence opt4 from anti-HIV_Chain
caggugcagcuggugcagagcggcgccgcccugaagaagcccggcgccagccugagaaucagcugccaggccuacggcuacaaguucaccgacuaccugauccacugguggagacaggcccccggccagggccuggaguggaucggcuggaucaagcccgagaccggccagcccagcuacagcuacaaguuccagggcagagugagccugaccagagacaccuucgaggagauccuguucauggaccugagaggccugagaagcgacgacaccgccaucuacuucugcgccagaagacacagcgacuacugcgacuucgacguguggggcggcggcagccaggugcuggugagcagcgccagcaccaagggc

SEQ ID NO: 34802 - RNA, 372 nt, Artificial Sequence
  derived and/or modified sequence opt4 from anti-HIV_Chain
gaggugcagcugcuggagagcggcggcgcccuggugcagcccggcggcagccugagacugagcugcgccgccagcggcuucaccuucagcaccagcagcaugagcugggugagacaggcccccggcaagggccuggagugggugagcgccaucggcagcggcagaggcagcaccuucuacgccgacagcgugaagggcagauucaccaucagcagagacaacagcaagaacacccugagccugcagaugaacagccugaccgccgaggacaccgccaccuacuacugcaccaagaccggcggccugcugagauuccccgagguguggggcaagggcaccaccgugaccgugagcagcgccagcaccaagggc

SEQ ID NO: 34803 - RNA, 372 nt, Artificial Sequence
  derived and/or modified sequence opt4 from anti-HIV_Chain
gaggugcagcugguggagagcggcggcggccuggugaagcccggcggcagccugagacugagcugcgccgacagcggcuucaccuucagaagcuacagcaugcacugggugagacaggcccccggcaagggccuggccugggugagcagcaucagcagcaccagcaacuacaucuacuacgccgacagcgugaagggcagauucaccaucagcagagacaacgccaagaacagccuguaccugcagaugaacagccugagagccgaggacaccgccguguacuacugcgccagaaccuucaucaccgccagcugguucgacagcuggggccagggcacccuggugaccgugagcagcgccagcaccaagggc

SEQ ID NO: 34804 - RNA, 372 nt, Artificial Sequence
  derived and/or modified sequence opt4 from anti-HIV_Chain
caggugcagcuggugcagagcggcgccgaggugaagaagcccggcgccagcgugaaggugagcugcaaggccagcggcuacaccuucaccaacuacggcgugagcugggugagacaggcccccggccagggccuggaguggaugggcuggaucagccccuacagcggcaacaccaacuacgcccagagacugcaggacagagugaccaugaccaccgacaccagcaccaacaccgccuacauggagcugagaagccugagaagcgacgacaccgccguguacuacugcgccgccagaagcuacuacuacuacagcauggacguguggggccagggcaccaccgugaccgugagcagcgccagcaccaagggc

SEQ ID NO: 34805 - RNA, 372 nt, Artificial Sequence
  derived and/or modified sequence opt4 from anti-HIV_Chain
caggugcagcuggugcagagcggcgccgagcugaagaagcccggcagcagcgugaaggugagcugcaaggccagcggcggcaccuucagcaacuacgccaucaacugggugagacaggcccccggccagggcuucgaguggaugggcggcaucaucccccuguucgccacccccaccuacgcccagaaguuccagggcagagugagaaucaccgccgacgacagcaccagcaccgccuacauggagcugagcagccugagaagcgacgacaccgccguguacuucugcgccagacccaacguggugagaagcgcccuggacuacuggggccagggcacccuggugaccgugagcagcgccagcaccaagggc

SEQ ID NO: 34806 - RNA, 372 nt, Artificial Sequence
  derived and/or modified sequence opt4 from anti-HIV_Chain
caggugcagcugguggagagcggcggcggcguggugcagcccggcaagagccugagacugagcugcgccgccagcggcuucaccuucagcacccacgccaugcacugggugagacaggcccccggcaagggccuggacuggguggccgugaucagccacgacggcgacaaccaguacuacgccgacgccgugaagggcagauucaccaucagcagagacgacagcagagacaccguguuccugcagaugaacagccugagaaccgaggacaccggcguguacuacugcgccgccgacagcagcggcagcaacugguucgacuacuggggccagggcauccuggugaccgugagcagcgccagcaccaagggc

SEQ ID NO: 34807 - RNA, 375 nt, Artificial Sequence
  derived and/or modified sequence opt4 from anti-HIV_Chain
caggugagacugagccagagcggcggccagaugaagaagcccggcgagagcaugagacugagcugcagagccagcggcuacgaguuccugaacugccccaucaacuggaucagacuggcccccggcagaagacccgaguggaugggcuggcugaagcccagaggcggcgccgugaacuacgccagaaaguuccagggcagagugaccaugaccagagacguguacagcgacaccgccuuccuggagcugagaagccugaccagcgacgacaccgccguguacuucugcaccagaggcaaguacugcaccgccagagacuacuacaacugggacuucgagcacuggggcagaggcgcccccgugaccgugagcagc

SEQ ID NO: 34808 - RNA, 375 nt, Artificial Sequence
  derived and/or modified sequence opt4 from anti-HIV_Chain
gaggugcagcuggugcagagcggcagcgacgugagaaagcccggcgccaccgugaccgugagcugcaaggccgacgaggacgaggacgacuucaccgccuacaacuacuucaugcacugggugagacaggcccccggccacggccuggaguggaucggcuggaucaaccccagaaccggccagcccaaccacgccaagcaguuccagggcagagugacccugaccagagagagaagcaccagcaccguguucaugaagcugaccaaccugagacuggacgacaccgccguguacuucugcgccagaccccugagaggcggcgacaccuggcacuaccacagcuggggcagaggcaccagccugaccgugagcagc

SEQ ID NO: 34809 - RNA, 375 nt, Artificial Sequence
  derived and/or modified sequence opt4 from anti-HIV_Chain
caggugcagcuggugcagagcggcggcggccuggugcagcccggcgagagccugagacugagcugcaccgccagcggcuucaccuucagcagcuacaacaugaacugggugagacaggcccccggcaagggccuggaguggaucagcuacaucagcgacaagagcaagaacaaguacuacgccgacagcgugagaggcagauucaccaucagcagagacaacgcccagaacagccuguuccugcagaugagcagccugagagacgaggacaccgccguguacuacugcaccagagagggcccccagagaagcuucuacuucgacuacuggggccagggcauccaggugaccgugagcagcgccagcaccaagggc

SEQ ID NO: 34810 - RNA, 375 nt, Artificial Sequence
  derived and/or modified sequence opt4 from anti-HIV_Chain
gaggugcagcugguggagagcggcgccgaggugaagaagcccggcagcagcgugaaggugagcugcaaggccagcggcggcaccuucagcagcuacagcaucagcugggugagacaggcccccggccagggccuggaguggaugggcggcaucauccccaucuucgccaccacccacuacggccagaaguuccagggcagaaucaagaucaccgccgacaagagcaccagcaccgccuacauggagcugagcagacugagaagcgaggacaccgccguguacuacugcgccagagacagagaguucuacuucuacggcauggacguguggggccagggcaccaccgugaccgugagcagcgccagcaccaagggc

SEQ ID NO: 34811 - RNA, 375 nt, Artificial Sequence
  derived and/or modified sequence opt4 from anti-HIV_Chain
cagcugcagcugcaggagagcggccccggccuggugaagcccugggagacccuggugcugaccugcagcgugagcggcggcagcaucagcagcggcgacuacuacuggggcuggaucagacagagccccggcaagggccccgaguggaucggcaacaucuucuacagcagcggcaacaccuacuacaacaccagccugaagagcagagugaccaucagcguggacgugagcaagaacagauucagccugaagcugaccagcaugaccgccgccgacaccgccguguacuacugcggcagacugagcaacaagggcugguucgaccccuggggccagggcacccuggugagcgugagcagcgccagcaccaagggc

SEQ ID NO: 34812 - RNA, 375 nt, Artificial Sequence
  derived and/or modified sequence opt4 from anti-HIV_Chain
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcgacaccgacuucacccugaccaucagcagccuggagcccgaggacuucgccguguacuacugccagcagagaggcaucuggccccugcagaucaccuucggccagggcaccagacuggagaucaagagaaccguggccgcccccagcguguucaucuucccccccagcgacgag

SEQ ID NO: 34813 - RNA, 375 nt, Artificial Sequence
  derived and/or modified sequence opt4 from anti-HIV_Chain
agcgagaucgugcugacccagagccccggcacccugagccugagccccggcgagagagccacccugagcugcagagccagccagagcgugagcagcagcuaccuggccugguaccagcagaagcccgugcaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcacccugcaccccagaaccuucggccagggcaccaagguggagaucaagagaaccguggccgcccccagcguguucaucuucccccccagcgac

SEQ ID NO: 34814 - RNA, 375 nt, Artificial Sequence
  derived and/or modified sequence opt4 from anti-HIV_Chain
agccaggccguggugacccagccccccagcgugagcggcgcccccggccagagagugaccaucagcugcagcggcggccccagcaacgugggcggcaaccugguguacugguacaagcaguuccccggcaccgcccccaagcugcugaucagaagagacgaccagagacccagcggcgugcccgacagauucagcggcagcaagagcggcaacagcgccagccuggccaucagcggccugagacccgacgacgaggccuucuacuucugcgccaccuacgacagccacggcagcaucagacuguucggcggcggcacccugcugaccgugcugagccagcccaaggccgcccccagcgugacccuguuccccccc

SEQ ID NO: 34815 - RNA, 375 nt, Artificial Sequence
  derived and/or modified sequence opt4 from anti-HIV_Chain
gacauccagaugacccagagccccagcacccuggccgccagcaucggcggcaccgugagagugagcugcagagccagccagagcaucaccggcaacuggguggccugguaccagcagagacccggcaaggcccccagacugcugaucuacagaggcgccgcccugcugggcggcgugcccagcagauucagcggcagcgccgccggcaccgacuucacccugaccaucggcaaccugcaggccgaggacuucggcaccuucuacugccagcaguacgacaccuaccccggcaccuucggccagggcaccaagguggaggugaagagaaccguggccgcccccagcguguucaucuucccccccagcgacgagcag

SEQ ID NO: 34816 - RNA, 375 nt, Artificial Sequence
  derived and/or modified sequence opt4 from anti-HIV_Chain
gagaucgugaugacccagagccccgacacccugagcgugagccccggcgagagagccacccugagcugcagagccagccagagcgugaacagcaaccuggccugguaccagcagaagcccggccaggcccccagacugcugaucuacggcgccagcaccagagccaccgccgugcccgccagauucagcggcagcggcagcggcaccgaguucacccugaccaucagcagccugcagagcgaggacagcgccguguacuacugccagcaguacuaccaguggcugagcuacaccuucggccagggcaccaagcuggagaucaagagaaccguggccgcccccagcguguucaucuucccccccagcgacgagcag

SEQ ID NO: 34817 - RNA, 375 nt, Artificial Sequence
  derived and/or modified sequence opt4 from anti-HIV_Chain
agacaggugcagcuggugcagagcggcgccgcccugaagaagcccggcgccagccugagaaucagcugccaggccuacggcuacaaguucaccgaccaccugaucuacugguggagacaggcccccggccagggccuggaguggaucggcuggaucaagcccgagaccggccagcccagcuacagcuacaaguuccagggcagagugagccugaccagagacaccuuccaggagauccuguucauggaccugagaggccugagaagcgacgacaccgccaucuacuucugcgccagaagacacagcgacuacugcgacuucgacguguggggcagcggcagccagauccuggugagcagcgccagcaccaagggc

SEQ ID NO: 34818 - RNA, 375 nt, Artificial Sequence
  derived and/or modified sequence opt4 from anti-HIV_Chain
caggugcagcuggugcagagcggcgccgcccugaagaagcccggcgccagcgugagaaucagcugccaggccuacggcuacaaguucaccgacuaccugauccacugguggagacaggcccccggccagggccuggaguggaucggcuggaucaagcccgagaccggccagcccagcuacagcuacaaguuccagggcagagugacccugaccagagacaccuucgaggagauccuguucauggaccugagaggccugagaagcgacgacaccgccaucuacuucugcgccagaagacacagcgacuacugcgacuucgacguguggggcagcggcagccaggugaucgugagcagcgccagcaccaagggcgcc

SEQ ID NO: 34819 - RNA, 375 nt, Artificial Sequence
  derived and/or modified sequence opt4 from anti-HIV_Chain
gaggugcagcugguggagagcggcggcggccuggugaagcccggcggcagccugagacugagcugcgccgccagcggcuucagcuucagcgagcacuacaugagcuggaucagacuggcccccggcaagggccuggaguggcugagcuacaucagcagcagcaccagaaccaccuacagcgccgacagcgugagaggcagauucaccaucagcagagacaccgccaagcagcugcuguuccugcacaugagcagccugagagccgaggacaccgccguguacuacugcgugagacuguacggcggcaucaacggcugguucgaccaguggggccagggcacccuggugagcgugagcagcgccagcaccaagggc

SEQ ID NO: 34820 - RNA, 375 nt, Artificial Sequence
  derived and/or modified sequence opt4 from anti-HIV_Chain
caggugcagcuggugcagagcggccccggccuggugaagcccagcgagacccugagccugaccugcagcgugagcaacggcagcaucagcagcggcggcuacuacuggagcuggcugagacaguuccccggcaagggccuggaguggaucggcagcauccacuacaccggcagaaccuucuacaaccccagccugaugggcagaaccgcccugagcauggacaccagcaacaaccaguucagccugaaggugagcagcgugaccgccgccgacaccgcccuguacuacugcgccagagagcugcaguggauguucgugguggaccccuggggccagggcacccuggugaccgugagcagcgccagcaccaagggc

SEQ ID NO: 34821 - RNA, 375 nt, Artificial Sequence
  derived and/or modified sequence opt4 from anti-HIV_Chain
caggugcagcugcaggagagcggccccggccuggugaagcccagcgagacccugagccugaccugcagcgugagcaacggcagcaucagcagcggcggcuacuacuggagcuggcugagacaguuccccggcaagggccuggaguggaucggcagcauccacuacaccggcagaaccauguacaaccccagccugaugggcagacccgcccugagcauggacaccagcaacaaccaguucagccugaagcugagaagcgugaccgccgccgacaccgcccuguacuucugcgccagagaccugcaguggaucuucgugguggaccccuggggccagggcacccuggugaccgugagcagcgccagcaccaagggc

SEQ ID NO: 34822 - RNA, 375 nt, Artificial Sequence
  derived and/or modified sequence opt4 from anti-HIV_Chain
gaggugcagcugcuggagagcggcggcggccuggugcagcccggcggcagccugagacugagcugcgccgugagcggcuucaccuucggcggccacgccgugagcugggugagacaggcccccggcaagggccuggaguggcugagccagaucagcggcaccggcagcagaaccgacuacgccgacgccgugaagggcagauucaccgugagcagagacaacagcaagaagaccguguaccugcagaugaacagccugagaguggaggacaccgcccuguucuacugcgccaccagaagccccggcggcggcuacgccuucgacaucuggggccagggcgccauggugaccgugagcagcgccagcaccaagggc

SEQ ID NO: 34823 - RNA, 375 nt, Artificial Sequence
  derived and/or modified sequence opt4 from anti-HIV_Chain
caggugcagcuggugcagagcggcgccgaggugaagaagcccggcagcagcgugaaggugagcugcaaggugagcuucuucagcaacuacggcaucagcugggugagacagagacccggccagggccuggaguggaugggcagaaucauccccgccaucgacgacaugaccuacgcccagaccuucagaggcagagugaccuucagcgccgacaaguucaccaccaccgccuacauggagcugaccggccugaccuucgaggacaccgccaccuacuucugcgccagagacccccaggugaacagaagaggcaacugcuucgaccacuggggccagggcacccuggugaccgugagcagcgccagcaccaagggc

SEQ ID NO: 34824 - RNA, 375 nt, Artificial Sequence
  derived and/or modified sequence opt4 from anti-HIV_Chain
caggugcagcugcaggagagcggccccggccuggugaagcccagcgagacccugagccugaccugcaccgugagcggcggcagcaucagcuacuacuacuggagcuggaucagacagccccccggcaagggccuggaguggaucggcgacaucuacuacagcggcaccaccgacuacaaccccagccugaagagcagagugaccaucagcguggacaccagcaagaaccaguucagccugaagcugagcagcgugaccgccgccgacaccgccguguacuacugcgccagaagaagaggccagagacugcuggccuacuucgacuacuggggccagggcagccuggugaccgugagcagcgccagcaccaagggc

SEQ ID NO: 34825 - RNA, 375 nt, Artificial Sequence
  derived and/or modified sequence opt4 from anti-HIV_Chain
caggugcagcugcaggagagcggccccggccccgugaagcccagcgagacccugagccugaccugcaccgugagcggcggcagcaugaucagcuacuacuggagcuggaucagacagccccccggcaagggccuggaguggaucggcuacaucuucaccaacggcagaaccaccuacagccccagccugagaagcagagugaccaucagccuggacaccagcaccaaccacuucagccugagacugaagagcgugaccgccgccgacaccgccaucuacuacugcgccagacuggacggcgaggccuucagauacuaccuggaccuguggggccagggcaaccuggugaccgugagcagcgccagcaccaagggc

SEQ ID NO: 34826 - RNA, 375 nt, Artificial Sequence
  derived and/or modified sequence opt4 from anti-HIV_Chain
caggugcagcuggugcagagcggcgccgaggugaagaagcccggcgccagcgugaaggugagcugcaagcccagcagcaacaccuucaccagccacuacauccacugggugagacaggcccccggccagggccuggaguggaugggcaugaucaaccccggcggcagcaccagauacgcccccaaguuccagggcagagugacccugaccagagacaccagcaccagaaccguguacauggagcugagcagccugagaagcgaggacaccgccguguacuacugcgccagaccccaguacaaccugggcagagacccccuggacguguggggccugggcaccauggugaccgugagcagcgccagcaccaagggc

SEQ ID NO: 34827 - RNA, 375 nt, Artificial Sequence
  derived and/or modified sequence opt4 from anti-HIV_Chain
caggugcagcugcagcaguggggcgccggccugcugaagcccagcgagacccugagccugaccugcgccguguacggcggcagcuucagcggcuacuacuggagcuggaucagacagccccccggcaagggccuggaguggaucggcgagaucaaccacagcggcagcaccaacuacaaccccagccugaagagcagagugaccaucagcguggacaccagcaagaaccaguucagccugaagcugagcagcgugaccgccgccgacaccgccguguacuacugcgccagacugcccaucggcagcggcugguacggcagagacuacuggggccagggcacccuggugaccgugagcagcgccagcaccaagggc

SEQ ID NO: 34828 - RNA, 375 nt, Artificial Sequence
  derived and/or modified sequence opt4 from anti-HIV_Chain
caggugcagcuggugcagagcggcgccgaggugaagaagcccggcgccagcgugaaggugagcugcaaggccagcggcaacaccuucaccagcuacggcaucaccugggugagacaggcccccggccagggccuggaguggaugggcuggaucagcgccuacaacggcaacaccaacuacgcccagaagcugcaggacagacugaccaugaccaccgacaccagcaccagcaccgccuacauggagcugagaagccugagaagcgacgacaccgccguguacuacugcgccuucagcagacacuacggcagcggcaacuacgacuacuggggccagggcacccuggugaccgugagcagcgccagcaccaagggc

SEQ ID NO: 34829 - RNA, 375 nt, Artificial Sequence
  derived and/or modified sequence opt4 from anti-HIV_Chain
caguucagacuggugcagagcggccccgaggugaagaaccccggcagcagcgugaccgugagcugcaaggccagcggcggcaccuucagcggccugggcaucaacugggugagacaggcccccggccagggccuggaguggcugggcgacaucaagaccauguacggcaccaccaacuacgcccccaaguuccagggcagagugaccaucaccgccgacgagagcaccagcaccagcuacauggagcugagcggccugagaagcgaggacaccgccguguucuacugcgugagagagcuguucggccaccaccccgccuucggcguguggggccagggcaccagcgugaucgugagcagcgccagcaccaagggc

SEQ ID NO: 34830 - RNA, 375 nt, Artificial Sequence
  derived and/or modified sequence opt4 from anti-HIV_Chain
agagugcagcuggugcagagcggcgccgaggugaagaagcccggcagcagcgugaccgugagcugcaaggccagcggcggcagcuucagcagcuacgccaucagcugggugagacaggcccccggccagggccuggagugggugggcggcgugaaggugauguucggcaccgugcacuacagccagaaggugcagggcagagugaccaucaccgccgacgacagcaccggcaccagcuaccuggagcugagcggccugagaagcgccgacaccgccguguacuacugcgccagaaacgccggcgccuacuucuaccccuucgacaucuggggccagggcacccugaucaucgugagcagcgccagcaccaagggc

SEQ ID NO: 34831 - RNA, 375 nt, Artificial Sequence
  derived and/or modified sequence opt4 from anti-HIV_Chain
caggugcagcugcaggagagcggccccggccuggugaagcccagcgagacccugagccugaccugcaccgugagcggcggcagcaucagcagcagaagcuacuacuggggcuggaucagacagccccccggcaagggccuggagugggugggcagcaucuacuacaccggcagcaccuacuacagccccagccugaagagcagagugaccaucagcguggacaccagccagaaccaguucagccugaagcugaacagcgugaccgccgccgacaccgccguguacuacugcgccagacagaagggcagcggcaccagccugcuguacuggggccagggcacccuggugaccgugagcagcgccagcaccaagggc

SEQ ID NO: 34832 - RNA, 375 nt, Artificial Sequence
  derived and/or modified sequence opt4 from anti-HIV_Chain
caggugcagcuggugcagagcggcaccgaggugaagaagcccggcagcagcgugaaggugagcugcaaggccagcggcggcaccuucagcgacagcgacaucgccugggugagacaggcccccggccagggccuggaguggaugggcggcaucacccccauguucgacauggccaagagcgcccagaaguucagaggcagacugaucaucaccgccgacaagagcaccggcaccgccuacauggagcugagcagccugagauacgaggacgccgccguguacuucugcgccagaagcagcggcaacuucgaguucgccuucgagaucuggggccagggcaccaagaucaucgugagccuggccagcaccaagggc

SEQ ID NO: 34833 - RNA, 375 nt, Artificial Sequence
  derived and/or modified sequence opt4 from anti-HIV_Chain
guggugcagcuggugcagagcggcaccgaggugaagaagcccggcagcagcgugaaggugagcugcaaggccagcggcggcaccuucagcggcagcgacaucagcugggugagacaggcccccggccagggccuggaguggaugggcggcaucauccccauguucgacaucgaggaccacgcccagaaguucagaggcagacugaccaucaccgccgacaagagcaccggcgccgccuacauggagcugagcagccugagaagcgaggacgccgccguguacuacugcgccagaagcagcggcaacuacgacuucgccuucgacaucuggggccagggcaccagacugaucgugagcagcgccagcaccaagggc

SEQ ID NO: 34834 - RNA, 375 nt, Artificial Sequence
  derived and/or modified sequence opt4 from anti-HIV_Chain
guggugcagcugguggagagcggcaccgaggugaagaagcccggcagcagcgugaaggugagcugcaaggccagcggcggcaccuucagcggcagcgacaucagcugggugagacaggcccccggccagggccuggaguggaugggcggcaucauccccauguucgacaucgagaaccacgccgagaaguucagaggcagacugaccaucaccgccgugaagagcaccggcgccgccuacauggagcugagcagccugagaagcgaggacgccgccguguacuacugcgccagaagcagcggcaacuacgacuucgccuacgacaucuggggccagggcaccagagugaucgugagcagcgccagcaccaagggc

SEQ ID NO: 34835 - RNA, 378 nt, Artificial Sequence
  derived and/or modified sequence opt4 from anti-HIV_Chain
caggugcagcuggugcagagcggcagcgccaugaagaagcccggcgccagcgugagagugagcugcuggaccagcgaggacaucuucgacaccaccgagcugauccacugggugagacaggcccccggccagggccuggaguggaucggcugggugaaggccgugagcggcgccgugaacuacggcagccuggacuucagacacagagugagccugaccagagacagagaccugagcaccgcccacauggacaucagaggccugacccaggacgacaccgccaccuacuucugcgccagacagaaguucgccagaggcgaccagggcugguucuucgaccuguggggcagaggcacccugaucguggugagcagcgcc

SEQ ID NO: 34836 - RNA, 378 nt, Artificial Sequence
  derived and/or modified sequence opt4 from anti-HIV_Chain
caggugcagcugcaggagagcggccccggccuggugaagcccagcgagacccugagccugaccugcaccgugagcggcggcagcaucagcaaccacuacuggagcuggaucagacagccccccggcaagggccuggaguggaucggcuacaucuaccacagcggcaacaucaacuacaagagcagccugaagagcagagccaccaucagcaucgacaccagcaacaaccaguucagccugaagcugagcagcgugaucgccgccgacaccgccguguacuacugcgccagaaacuucggccccggcagccccaacuacggcauggacguguggggccagggcaccaccgugaccgugagcagcgccagcaccaagggc

SEQ ID NO: 34837 - RNA, 378 nt, Artificial Sequence
  derived and/or modified sequence opt4 from anti-HIV_Chain
caggugcagcuggugcagagcggcggcggcguggugcagcccggcagaagccugagacugagcugcgccgccagcggcuucaccuucagccaccacggcauccacugggugagacaggcccccggcgagggccuggaguggguggccgugaucagcgaggacggcaccaacauccacuacgaggacagcgugagaggcagauucaccaucagcagagacaacagcaagaacaccguggaccugcagaugaacagccugagagccgaggacaccgccguguacuacugcgccagccugaucagcaugagagacggcgacgccuucgaccuguggggccagggcaccagagugaccgugagcagcgccagcaccaagggc

SEQ ID NO: 34838 - RNA, 378 nt, Artificial Sequence
  derived and/or modified sequence opt4 from anti-HIV_Chain
caggugcagcugguggagagcggcggcggccugggccagcccggcggcagccugagacugagcugcgccgccagcggcuucaccuucagaaacuacgccaugagcugggugagacaggccgccggcaagggccuggagugggugagcggcgugagcggcggcggcgacaccaccuacuacggcgacagcgugaagggcagauucaccaucagcagagacaacagcaagaacacccuguaccugcagaugaacaaccugagagccgaggacaccgccguguacuacugcgccaaggacaagggcguguggggcagcagcgacuucgacuacuggggccagggcacccuggugaccgugagcagcgccagcaccaagggc

SEQ ID NO: 34839 - RNA, 378 nt, Artificial Sequence
  derived and/or modified sequence opt4 from anti-HIV_Chain
gaggugcagcugguggagagcggcggcggcguggugcagcccggcagaagccugagacugagcugcgccgccagcggcuucaccuucagccaccacggcauccacugggugagacaggcccccggcgagggccuggaguggguggccgugaucagcgaggacggcaccaacauccacuacgaggacagcgugagaggcagauucaccaucagcagagacaacagcaagaacaccguggaccugcagaugaacagccugagagccgaggacaccgccguguacuacugcgccagccugaucagcaugagagacggcgacgccuucgaccuguggggccagggcaccagagugaccgugagcagcgccagcaccaagggc

SEQ ID NO: 34840 - RNA, 378 nt, Artificial Sequence
  derived and/or modified sequence opt4 from anti-HIV_Chain
agaggccccgugacccuggccgugagccugggcgagagagccaccaucaccugcaagagcagccagagcgugcuggugcacagcaacaacaagaacuaccugagcugguaccagcagaagcccggccagccccccaagcugcugaucuacugggccagcaccagagagagcggcgugcccgagagauucagcggcagcggcagcggcaccgacuucacccugagcaucagcagccugcaggccgaggacguggccguguacuacugccaccaguacuucagcacccccagaaccuucggccagggcaccaagguggagaucaagggcaccguggccgcccccagcguguucaucuucccccccagcgacgagcagcug

SEQ ID NO: 34841 - RNA, 378 nt, Artificial Sequence
  derived and/or modified sequence opt4 from anti-HIV_Chain
agcgagaucgugaugacccagagccccgccacccugagcaugagccccggcgagagagccacccugagcugcagagccagccugagcgugaacaccaaccuggccugguaccagcagaagcccggccaggcccccagacugcugaucuacggcgccagcaccagagccaccggcauccccgccagauucagcggcagcggcagcggcaccgaguucacccugaccaucagcagccugcagagcgaggacuucgcccuguacuacugccagcaguacaaccacuggccccagaccuucggccagggcaccaagguggagaucaagagaaccguggccgcccccagcguguucaucuucccccccagcgacgagcagaag

SEQ ID NO: 34842 - RNA, 378 nt, Artificial Sequence
  derived and/or modified sequence opt4 from anti-HIV_Chain
agcgagaucgugcugacccagagccccgccacccugagccugagccccggcgagagagccacccugagcugcagagccagccagagcaucaacaacuaccuggccugguaccagcagaagcccggccaggcccccagacugcugaucuacgacgccagcaacagagccaccggcauccccgccagauucagcggcggcggcagcggcaccgacuucacccugaccaucagcagccuggagcccgaggacuucgccguguacuacugccagcagagagccaacuggagacugcugaccuucggcggcggcaccaagguggagaucaagagaaccguggccgcccccagcguguucaucuucccccccagcgacgagcag

SEQ ID NO: 34843 - RNA, 378 nt, Artificial Sequence
  derived and/or modified sequence opt4 from anti-HIV_Chain
caggugcagcuggugcagagcggcggcgccgugaagaagcccggcgccagcgugaaggugagcugcgagaccuacggcuacaccuucaccgaccacuucaugcacugguggagacaggcccccggccagggccuggaguggaugggcuggaucaaccccuacagcagcgccgugagcuacagccccagauaccagggcagagugaccaugaccagagacaccuuccuggagaccguguacauggagcugagaggccugaaguucgacgacaccgccaucuacuacugcgccacccccaagagcggcagagacuacuggagcuucgaccuguggggccagggcacccuggugaccgugagcagcgccagcaccaagggc

SEQ ID NO: 34844 - RNA, 378 nt, Artificial Sequence
  derived and/or modified sequence opt4 from anti-HIV_Chain
agccaggugcagcugguggagagcggccccggccuggugaagcccagcgagacccugagccugaccugcagcgugagcaacggcagcaucagcagcggcggcuacuacuggagcuggcugagacaguuccccggcaagggccuggaguggaucggcagcauccacuacaccggcagaaccauguacaaccccagccugaugggcagacccgcccugagcauggacaccagcaacaaccaguucagccugaagcugagcagcgugaccgccgccgacaccgcccuguacuucugcgccagagaccugcaguggaucuucgugguggaccccuggggccagggcacccuggugaccgugagcagcgccagcaccaagggc

SEQ ID NO: 34845 - RNA, 378 nt, Artificial Sequence
  derived and/or modified sequence opt4 from anti-HIV_Chain
agcguggugcagcugguggagagcggccccggccuggugaagcccagcgagacccugagccugaccugcagcgugagcaacggcagcaucagcagcggcggcuacuacuggagcuggcugagacaguuccccggcaagggccuggaguggaucggcagcauccacuacaccggcagaaccauguacaaccccagccugaugggcagacccgcccugagcauggacaccagcaacaaccaguucagccugaagcugagaagcgugaccgccgccgacaccgcccuguacuucugcgccagagaccugcaguggaucuucgugguggaccccuggggccagggcacccuggugaccgugagcagcgccagcaccaagggc

SEQ ID NO: 34846 - RNA, 378 nt, Artificial Sequence
  derived and/or modified sequence opt4 from anti-HIV_Chain
agcggcggcagacuggugcagcccggcggcagccugagacugagcugcagcgccagcggcuucacccugagcaacagcgccaugagcugggugagacaggcccccggcaagggccuggagugggugagcagcauccugagcagcggcgugggcaccuucuacgccgacagcgugaagggcagauucaccgugagcagagacaacagcagaaacacccuguaccugcagaugaagagccugagagccgaggacaccgcccuguacuacugcgccaaggugcagauccagcagcugaacuucggcgugaucaccgacgccggccuggacguguggggcaagggcaccacccugaucgugagcagcgccagcaccaagggc

SEQ ID NO: 34847 - RNA, 378 nt, Artificial Sequence
  derived and/or modified sequence opt4 from anti-HIV_Chain
caggugcagcuggugcagagcggcgccgccgugaagaagcccggcgccagcgugaaggugagcugcgaggccuacggcuacaaguucaccgaccacuucaugcacugguggagacaggcccccggccagggccuggaguggaugggcuggaucaaccccuacaccagcgccgugaacuacagccccaaguaccagggcagagugaccaugaccagagacaccuuccuggagaccguguacauggagcugagaggccugagaguggacgacaccgccaucuacuacugcgccacccccaagagcggcagagacuacuggagcuucgaccuguggggccagggcacccuggugaccgugagcagcgccagcaccaagggc

SEQ ID NO: 34848 - RNA, 378 nt, Artificial Sequence
  derived and/or modified sequence opt4 from anti-HIV_Chain
caggugcagcuggugcagagcggcgccgccgugaagaagcccggcgccagcgugaaggugagcugcgagaccuacggcuacaaguucaccgaccacuucaugcacugguggagacaggcccccggccagggccuggaguggaugggcuggaucaaccccuacagcagcgccgugagcuacagccccagauaccagggcagagugaccaugaccagagacaccuuccuggagaccguguacauggagcugagaggccugagauucgacgacaccgccaucuacuacugcgccacccccaagagcggcagagacuacuggagcuucgaccuguggggccagggcacccuggugaccgugagcagcgccagcaccaagggc

SEQ ID NO: 34849 - RNA, 378 nt, Artificial Sequence
  derived and/or modified sequence opt4 from anti-HIV_Chain
caggugcagcuggugcagagcggcgccgccgugaagaagcccggcgccagcgugaaggugagcugcgagaccuacggcuacaccuucaccgaccacuucaugcacugguggagacaggcccccggccagggccuggaguggaugggcuggaucaaccccuacagcagcgccgugagcuacagccccagauaccagggcagagugaccaugaccagagacaccuuccuggagaccguguacauggagcugagaggccugaaguucgacgacaccgccaucuacuacugcgccacccccaagagcggcagagacuacuggagcuucgaccuguggggccagggcacccuggugaccgugagcagcgccagcaccaagggc

SEQ ID NO: 34850 - RNA, 378 nt, Artificial Sequence
  derived and/or modified sequence opt4 from anti-HIV_Chain
caggugcagcuggugcagagcggcgccgaggugaagaagcccggcagcagcgugaaggugagcugcaagaccagcggcgugagauucagcagcaacgccaucagcugggugagacaggcccccggccagggccuggaguggaugggcagaaccacccccaugcugggcggcgccaaccacgcccccagcuucaagggcagagugaccaucagcgccgacgagagcaccagaaccguguacauggagaugagcagccugagauacgaggacaccgccguguacuacugcgccagcggcagaagagagggccugaacuuccugcuggacuacuggggccagggcacccuggugaccgugagcagcgccagcaccaagggc

SEQ ID NO: 34851 - RNA, 378 nt, Artificial Sequence
  derived and/or modified sequence opt4 from anti-HIV_Chain
caggugcagcugcaggagagcggccccggccuggugaagcccagcgagacccugagccugaccugcaccgugagcggcggcagcaucagcaccuacuacuggagcuggaucagacagccccccggcaagggccuggaguggaucggcuacaucagcuacagcggcagcaccaacuacaaccccagccugaagagcagagugaccaucagcguggacaccagcaagaaccaguucagccugaagcugagcagcgugaccgccgccgacaccgccguguacuacugcgccagacacaagagcgugcugcugugguucagagagcuggacuacuggggccagggcacccuggugaccgugagcagcgccagcaccaagggc

SEQ ID NO: 34852 - RNA, 378 nt, Artificial Sequence
  derived and/or modified sequence opt4 from anti-HIV_Chain
caggugcagcuggugcagagcggcgccgaggugaagaagcccggcgccgccgugaagaucagcugcaaggccagcagauucaccuucagcagcuacuacauccacugggugagacaggcccccggccagggccuggaguggaugggcaucaucaaccccagcggcggcagcaccagcaacgcccagaaguuccaggacagagugacccugaccagagacaugagcaccggcaccguguacauggagcugagcagacugaccagcgaggacaccgccguguacuacugcgccacccccgagcccagcagcaucguggccccccuguacuacuggggccagggcacccuggugaccgugagcagcgccagcaccaagggc

SEQ ID NO: 34853 - RNA, 378 nt, Artificial Sequence
  derived and/or modified sequence opt4 from anti-HIV_Chain
caggugcagcuggugcagagcggcgccgagaugaagaagcccggcgccagcgugaaggugagcugcaaggccagcggccacaccuucaccaacuacuacaugcacugggugagacaggcccccggccagggccuggaguggaugggcaugaucaaccccaccggcgacagcaccagauacgcccagagauuccagggcagagugaccaugaccagagacaccagcaccagaaccguguacauggagcugagcagccugagaagcgacgacaccgccguguacuacugcgccagagcccaccacgacuucuggagagcccccguggacguguggggcaagggcaccaccgugaccgugagcagcgccagcaccaagggc

SEQ ID NO: 34854 - RNA, 378 nt, Artificial Sequence
  derived and/or modified sequence opt4 from anti-HIV_Chain
cagguggugcugauccagagcggcgccgaggugaagagacccggcagcagcgugaaggugagcugcaaggccagcggcggcagcuuccccaucaccugggugagacaggcccccggccacggccuggaguggaugggcggcaucaaccccuucuucggcaccaccaacuacgcccagaaguuccagggcagagugagcaucaccgccgacgagagcaccagcaccaccuaccugcaccugagcgaccugagaagcgaggacaccgccguguacuucugcgccagagagaacagagagaaguggcuggugcugagaagcugguucgcccccuggggccagggcacccuggugaccgugagcagcgccagcaccaagggc

SEQ ID NO: 34855 - RNA, 378 nt, Artificial Sequence
  derived and/or modified sequence opt4 from anti-HIV_Chain
agccagcagcuggugcagagcggcgcccaggugaagaagcccggcgccagcgugagagugagcugccaggccagcggcuacaccuucaccaaccacuuccugcacugguggagacaggcccccagacagggccuggaguggaugggcuggaucaaccccgugcacggcggcagaaacuacgccagaagauuccagggcagaaucaacuucggcagagacguguaccaggagaccgccuacauggagcugagcggccugagaaacgacgacaccgccaccuacuucugcgccagaggcggcggcgacggcagaaacuggcaccugcaccccuggggccagggcacccuggugaucgugagcgccgccagcaccaagggc

SEQ ID NO: 34856 - RNA, 378 nt, Artificial Sequence
  derived and/or modified sequence opt4 from anti-HIV_Chain
gaggugcaggugguggagagcggcggcggccuggugcagcccggcggcagccugagacugagcugcguggccagcggcuucaccuucagcgaguacuggaugagcugggugagacaggcccccggcaagggccuggaguggguggccaccaucaagagagacggcagcgaggagagcuacguggacagcgugaagggcagauucaccaucagcagagacaacgccaagaacagccuguaccugcagaugaacagccugagagccgaggacaccgccguguacuacugcgccagagugagagaccccaacuacaaccugcacuucgacagcuggggccagggcacccuggugaccgugagcagcgccagcaccaagggc

SEQ ID NO: 34857 - RNA, 378 nt, Artificial Sequence
  derived and/or modified sequence opt4 from anti-HIV_Chain
cuggugcagcugguggagagcggcggcggcguggugcagcccggcaagagccugagacugagcugcgccaccagcggcuucaccuucagcaccuacggcaugcacugggugagacaggcccccggcaagggccuggaguggguggccgugaucugguacgacggcagcuacaaguacuacgccgacagcgugaagggcagauucaccaucagcagagacaacagcaagaacacccuguuccugcagaugaacagccugagagccgaggacaccgccauguacuacugcggcagagagauggccgugggcggcaccaaggcccuggaccacuggggccagggcacccuggugaccgugagcagcgccagcaccaagggc

SEQ ID NO: 34858 - RNA, 378 nt, Artificial Sequence
  derived and/or modified sequence opt4 from anti-HIV_Chain
gaguuccagcuggugcagagcggcggcggccuggugaagcccggcggcagccugagacugagcugcaccggcagcaccuucagcuucagcagcgacgacaugaacugggugagacaggcccccggcaagggccuggagugggugagcagcaugagcgacagcggcagccacaucuacuacgccgacuucgugaagggcagauucaccaucagcagagacaacgccaagaagagccuguaccugcagaugaacagccugagagccgaggacaccgccguguacuacugcgcccagagcagacccccccagagacuguacggcauggacguguggggccagggcaccaccgugaccgugagcagcgccagcaccaagggc

SEQ ID NO: 34859 - RNA, 381 nt, Artificial Sequence
  derived and/or modified sequence opt4 from anti-HIV_Chain
gaggugcagcugguggagagcggcggcggcguggugcagcccggcggcagccugagacugagcugcgccgccagcggcuucauguucaagaacuacgccaugcacugggugagacagccccccggcaagggccuggaguggguggccgugaucugguacggcggcagagaccagaacuacgccgacagcgugaagggcagauucaccaucagcagagacgacagcgacaacacccuguaccugcagaugaacagccugagagccggcgacaccgccguguacuucugcgccagaaacagccaggugggcagacugaugcccgccgccggcguguggggccagggcacccuggugaccgugagcagcgccagcaccaagggc

SEQ ID NO: 34860 - RNA, 381 nt, Artificial Sequence
  derived and/or modified sequence opt4 from anti-HIV_Chain
cagggccaccuggugcagagcggcggcggcgugaagaagcugggcaccagcgugaccaucagcugccuggccagcgaguacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugaccagcgccagcacc

SEQ ID NO: 34861 - RNA, 381 nt, Artificial Sequence
  derived and/or modified sequence opt4 from anti-HIV_Chain
caggugcagcugcuggagagcggcggcggccuggugcagagaggcggcagccugagacugagcugcaccgccagcggcuucguguucaacaacuacuggaugaccugggugagacaggcccccggcaacggccuggaguggguggccaacaucgaccaggacggcagcgagaagcacuaccuggacagcgugaagggcagauucaccaucagcagagacaacgccaagaacagccuguaccugcagaugaacagccugagagccgaggacaccgccaucuacuacugcgccagagugagauucaaggugaccgccuggcacagauucgacagcuggggccagggcgaccuggugaccgugagcagcaccagcaccaagggc

SEQ ID NO: 34862 - RNA, 381 nt, Artificial Sequence
  derived and/or modified sequence opt4 from anti-HIV_Chain
cagagcgcccugacccagccccccagcgccagcggcacccccggccagagagugaccaucagcugcagcggcagcuaccacaacaucggcagcaacgccgugaacugguaccagcagcugcccggcaccgcccccaagcugcugaucuacagcaacgaccagagacccagcggcgugcccgacagauucagcggcagcaagagcggcaccagcgccagccuggccaucagcggccugcagagcgaggacgaggccgacuacuacugcgccgccugggacgacagccugcacguguucggcaccggcaccaaggugaccgugcugggccagcccaaggccaaccccaccgugacccuguucccccccagcagcgaggagcug

SEQ ID NO: 34863 - RNA, 381 nt, Artificial Sequence
  derived and/or modified sequence opt4 from anti-HIV_Chain
cagagcgugcugacccaggugcugagcgugagcggcacccccggccagagagugaucaucagcugcagcggcaccagcagcaacgugggcggcaaccuggugagcugguaccagcaccugcccggcgccgcccccagacugcugauccacagagacgaccagagacccagcggcgugcccgacagauucagcggcagcaagagcggcaacagcgccagccuggugaucagcggccugagaagcgacgacgaggccgacuacuucugcgccgccuacgacagcaccuucagccugcccguguucggcggcggcaccagacugaccgugcugagccagcccaaggccgcccccagcgugacccuguucccccccagcagcgag

SEQ ID NO: 34864 - RNA, 381 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccugccaguuccagggcagagugagccugaccagacacgccagcugggacuucgacaccuucagcuucuacauggaccugaaggcccugagaagcgacgacaccgccguguacuucugcgccagacagagaagcgacuacugggacuucgacguguggggcagcggcacccaggugaccgugagcagcgccagcaccaag

SEQ ID NO: 34865 - RNA, 381 nt, Artificial Sequence
  derived and/or modified sequence opt4 from anti-HIV_Chain
caggugcagcuggugcagagcggcggcgaggugagaaagcccggcagcagcgugaaggugcccugcaagaucagcggcaacgccuucagcaacuacggcgugaacugggugagacaggcccccggccagggccuggagugggugggcagaaucauccccgugaucggcguggcccagcacgcccccaaguuccagggcagagugaccaucaccgccgacaagagcaccaccaccgccuaccuggagcugagcagccugagaagcgacgacaccgccguguacuucugcgccaaggaccacggcgaccccagaaccggcuacuacuucgacuacuggggccagggcgcccuggugaccgugagcagcgccagcaccaagggc

SEQ ID NO: 34866 - RNA, 381 nt, Artificial Sequence
  derived and/or modified sequence opt4 from anti-HIV_Chain
caggugcagcugggccagagcggcaccgaggugaagaagcccggcuucagcgugaaggugagcugcaaggccagcggcggcagcagcaccgccuacggcuacagcugggugagacaggcccccggccagggcuucgaguggaugggcagaaucauccccuucuacggcaucaucaccuacgcccccaaguuccagggcagagugaccaucaccgccgacagaagcaccagcaccguguacauggagcugaccagccugaccuucgccgacaccgcccuguucuucugcgccagagacuucggcgaccccagaaacggcuacuacuucgacagcugggaccagggccuguggcugaccgugagcagcgccagcaccaagggc

SEQ ID NO: 34867 - RNA, 381 nt, Artificial Sequence
  derived and/or modified sequence opt4 from anti-HIV_Chain
caggugcagcuggugcagagcggcgccgaggugaagaagcccggcagcagcgugaaggugagcugcaaggccagcggcggcaccuucagcaacuacgccaucagcugggugagacaggcccccggccagggccuggaguggaugggcggcaucauccccaucuucgaggccgccagcuacgcccagaaguuccaggacagacugaccaucaccaccgacgagagcaccaccaccgccuacauggaccugagcagccugagaagcgaggacaccgccaucuacuacugcgccagagcccagggcgacauccugaccgagggcuacuucgacuacuggggccagggcacccuggugaccgugagcagcgccagcaccaagggc

SEQ ID NO: 34868 - RNA, 381 nt, Artificial Sequence
  derived and/or modified sequence opt4 from anti-HIV_Chain
caggugcagcugcaggagagcggccccggccuggugaagcccagcgagacccugagccugaccugcaccgugagcggcggcagcaucagcagcgccggcuacuacuggagcuggaucagacagcaccccgagaagggccuggaguucaucggcuacaucuacuaccugggcaccaccuacuacaaccccagccugaagagcagagugagcaucagcaucgacaccagcaacaaccaguucagccuggagcugagcagcgugagcgccgccgacaccgccaucuacuacugcgccagagacuacaccgccagcggcagacacuucuucgacuacuggggccagggcacccuggugaccgugagcagcgccagcaccaagggc

SEQ ID NO: 34869 - RNA, 381 nt, Artificial Sequence
  derived and/or modified sequence opt4 from anti-HIV_Chain
caggugcagcuggugcagagcggcgccgaggugaagaagcccggcgccagcgugaaggugagcugcaaggcccccggcuacaccuucaucggccacuacaugcacuggaucagacaggcccccggccagggccuggaguggaugggcuggaucaaccccaacagcggcgacaccaacuacgcccagaccuuccagggcagagugaccaugaccagagacaccagcaucagcaccgccuacauggagcugaccagacugagaagcgacgacaccgccguguacuacugcgccagagaccugagacccaugagaggcaacugggccaugcacguguggggcgagggcaccaccgugaccgugagcagcgccagcaccaagggc

SEQ ID NO: 34870 - RNA, 381 nt, Artificial Sequence
  derived and/or modified sequence opt4 from anti-HIV_Chain
caggugcagcugcaggagagcggccccggccuggugaagcccagcgagacccugagccugaccugcaccguguucggcgccagcaucagaagcuucuacuggcacuggaucagacagagccccggcaagggccuggaguggcugggcagcguguucgacaacggccugaccaccuacaaccccagccugaagaacagacugagcaucagcgaggaccccagcagaaaccagaucagccugaaccugagaagcaugaccgccgccgacaccgccguguacuacugcgccagagccgacuacgaccugcugaccagcagcuaccacuucgacagcuggggccagggcacccuggugaccgugagcagcgccagcaccaagggc

SEQ ID NO: 34871 - RNA, 381 nt, Artificial Sequence
  derived and/or modified sequence opt4 from anti-HIV_Chain
agccagcagcuggugcagagcggcacccaggugaagaagcccggcgccagcgugagagugagcugccaggccagcggcuacaccuucaccgacuacgugcugcacugguggagacaggcccccggccagggccuggaguggaugggcuggaucaagcccguguacggcgccagaaacuacgcccacagauuccagggcagaaucaacuucgacagagacguguacagagagaucgccuacauggaccugagcggccugagaagcgacgacaccgccguguacuucugcgccagagacggcagcggcgacgccaccagcuggcaccugcaccccuggggccagggcacccuggugaucgugagcagcgccagcaccaagggc

SEQ ID NO: 34872 - RNA, 381 nt, Artificial Sequence
  derived and/or modified sequence opt4 from anti-HIV_Chain
agccagcagcuggugcagagcggcacccaggugaagaagcccggcgccagcgugagagugagcugccaggccagcggcuacaccuucaccaacuacauccugcacugguggagacaggcccccggcagaggccuggaguggaugggccugaucaagcccguguacggcgccgugaacuacgccagacaguuccagggcagaauccagcugaccagagacaucuacagagagaucgccuuccuggaccugagcggccugagacccgacgacaccgccguguacuacugcgccagagacgagagcggcuacgaccugaacuggcaccuggacagcuggggccagggcacccaggugaucgugagccccgccagcaccaagggc

SEQ ID NO: 34873 - RNA, 381 nt, Artificial Sequence
  derived and/or modified sequence opt4 from anti-HIV_Chain
agccagcagcuggugcagagcggcgcccaggugaagaagcccggcgccagccugagagugagcugccaggccagcggcuacaccuucaugaacuaccugcugcacugguggagacaggcccccggccagggccuggaguggaugggcuggaucaaccccguguacggcgccgugaacuacgcccacagauuccagggcagacugaccuucagcagagacguguacagagagaucgccuacauggaccugaacggccugagaagcgacgacaccgccguguacuucugcgccagagacggcagcggcgacgacagaaacuggcaccuggaccccuggggccagggcacccuggugaucgugagcagcgccagcaccaagggc

SEQ ID NO: 34874 - RNA, 381 nt, Artificial Sequence
  derived and/or modified sequence opt4 from anti-HIV_Chain
agccagcagcuggugcagagcggcacccaggugaagaagcccggcgccagcgugagaaucagcugccaggccagcggcuacaccuucaccgacuacgugcugcacugguggagacaggcccccggccagggccuggaguggaugggcuggaucaagcccguguacggcgccagaaacuacgccagaagauuccagggcagaaucaacuucgacagagacaucuacagagagaucgccuuccuggaccugagcggccugagaagcgacgacaccgccagauacuucugcgccagagacggcagcggcgacgacaccagcuggcaccugcaccccuggggccagggcacccuggugaucgugagcgccgccagcaccaagggc

SEQ ID NO: 34875 - RNA, 381 nt, Artificial Sequence
  derived and/or modified sequence opt4 from anti-HIV_Chain
agccagcagcuggugcagagcggcacccaggugaagaagaccggcgccagcgugagagugagcugccaggccagcggcuacgacuucaccaaguaccugauccacugguggagacaggcccccggccagggccuggaguggaugggcuggaugaagcccguguacggcgccaccaacuacgcccacagauuccagggcagaaucagcuucaccagagacaucuacagagagaucgccuucauggaccugaacggccugagaagcgacgacaccgccguguacuucugcgccagagacggcggcggcgacgacagaaccuggcugcuggacgccuggggccagggcacccuggugaucgugagcagcgccagcaccaagggc

SEQ ID NO: 34876 - RNA, 381 nt, Artificial Sequence
  derived and/or modified sequence opt4 from anti-HIV_Chain
agccagcagcuggugcagagcggcacccaggugaagaagcccggcgccagcgugagagugagcugccaggccagcggcuacaccuucaugaacuacaucauccacugguggagacaggcccccggccagagacuggaguggaugggcuggaucaaccccguguucggcgccagaaacuacgcccacagauuccagggcagaaucaacuucgacagagacaucaacagagagaccuuccagauggaccugaccggccugagaagcgacgacaccgccguguacuacugcgccagagacggcagcggcgacgccagagacuggcaccugcaccccuggggccagggcacccuggugaucgugagcagcgccagcaccaagggc

SEQ ID NO: 34877 - RNA, 381 nt, Artificial Sequence
  derived and/or modified sequence opt4 from anti-HIV_Chain
agccagcaccuggugcagagcggcacccaggugaagaagcccggcgccagcgugagagugagcugccaggccagcggcuacaccuucaccaacuacauccugcacugguggagacaggcccccggccagggccuggaguggaugggccugaucaagcccguguucggcgccgugaacuacgccagacaguuccagggcagaauccagcugaccagagacaucaacagagagaucgccuuccuggaccugagcggccugagaagcgacgacaccgccguguacuacugcgccagagacgagagcggcgacgaccugaaguggcaccugcaccccuggggccagggcacccaggugaucgugagccccgccagcaccaagggc

SEQ ID NO: 34878 - RNA, 381 nt, Artificial Sequence
  derived and/or modified sequence opt4 from anti-HIV_Chain
agccagcagcuggugcagagcggcacccaggugaagaagcccggcgccagcgugagagugagcugccaggccagcggcuacaccuucaugaacuacaucauccacugguggagacaggcccccggccagagacuggaguggaugggcuggaucaaccccguguucggcgccagaaacuacgcccacagauuccagggcagaaucaacuucgacagagacaucaacagagagaccuuccagauggagcugaccggccugagaagcgacgacaccgccguguacuacugcgccagagacggcagcggcgacgccagagacuggcaccuggaccccuggggccagggcacccuggugaucgugagcagcgccagcaccaagggc

SEQ ID NO: 34879 - RNA, 381 nt, Artificial Sequence
  derived and/or modified sequence opt4 from anti-HIV_Chain
agccagcagcuggugcagagcggcacccaggugaagaagcccggcgccagcgugagaaucagcugccaggccagcggcuacaccuucaccgacuacgugcugcacugguggagacaggcccccggccagggccuggaguggaugggcuggaucaagcccguguacggcgccagaaacuacgccagaagauuccagggcagaaucaacuucgacagagacaucuacagagagaucgccuacauggaccugagcggccugagaagcgacgacaccgccagauacuucugcgccagagacggcagcggcgacgacaccagcuggcaccugcaccccuggggccagggcacccuggugaucgugagcgccgccagcaccaagggc

SEQ ID NO: 34880 - RNA, 381 nt, Artificial Sequence
  derived and/or modified sequence opt4 from anti-HIV_Chain
agccagcagcuggugcagagcggcacccaggugaagaagcccggcgccagcgugagaaucagcugccaggccagcggcuacagcuucaccgacuacgugcugcacugguacagacaggcccccggccagggccuggaguggaugggcuggaucaagcccguguacggcgccagaaacuacgccagaagauuccagggcagaaucaacuucgacagagacaucuacagagagaucgccuucauggaccugagcggccugagaagcgacgacaccgcccuguacuucugcgccagagacggcagcggcgacgacaccagcugguaccuggaccccuggggccagggcacccuggugaucgugagcgccgccagcaccaagggc

SEQ ID NO: 34881 - RNA, 381 nt, Artificial Sequence
  derived and/or modified sequence opt4 from anti-HIV_Chain
agccagcagcuggugcagagcggcacccaggugaagaagcccggcgccagcgugagaaucagcugccaggccagcggcuacagcuucaccgacuacgugcugcacugguggagacaggcccccggccagggccuggaguggaugggcuggaucaagcccguguacggcgccagaaacuacgccagaagauuccagggcagaaucaacuucgacagagacaucuacagagagaucgccuucauggaccugagcggccugagaagcgacgacaccgcccuguacuucugcgccagagacggcagcggcgacgacaccagcuggcaccuggaccccuggggccagggcacccuggugaucgugagcgccgccagcaccaagggc

SEQ ID NO: 34882 - RNA, 381 nt, Artificial Sequence
  derived and/or modified sequence opt4 from anti-HIV_Chain
agccagcaccuggugcagagcggcacccaggugaagaagcccggcgccagcgugagagugagcugccaggccagcggcuacaccuucaccaacuacauccugcacugguggagacaggcccccggccagggccuggaguggaugggccugaucaagcccguguucggcgccgugaacuacgccagacaguuccagggcagaauccagcugaccagagacaucuacagagagaucgccuuccuggaccugagcggccugagaagcgacgacaccgccguguacuacugcgccagagacgagagcggcgacgaccugaaguggcaccugcaccccuggggccagggcacccaggugaucgugagccccgccagcaccaagggc

SEQ ID NO: 34883 - RNA, 381 nt, Artificial Sequence
  derived and/or modified sequence opt4 from anti-HIV_Chain
caggugcagcugguggagagcggcggcggcguggugcagcccggcaagagccugagacugagcugcgccaucagcggcuuccuguucaacaacuacggcggccagugggugagacaggcccccggcaagggccuggaguggguggccgccaucagcuacgacggcaacaacagauacuacgccgacagcgccaagggcagauuccugaucagcagagacacccccaagaacauccuguaccugcagaucuacagccugagacuggacgacaccgccguguacuacugcgccagagacagcgugagcaagagcuacagcgccccccccgaguucuggggccagggcaccguggugaccgugagcagcgccagcaccaagggc

SEQ ID NO: 34884 - RNA, 381 nt, Artificial Sequence
  derived and/or modified sequence opt4 from anti-HIV_Chain
caggugcaccuggaggagagcggccccggccuggugaagaccagccagacccugagccugaccugcagcgugagcagcuacagcaucagcagaagcggcuacuucuggaccuggaucagacagagacccggcaagggccuggaguggaucggcuacaucuacuucaacggcagaaccaccuacaaccccagccugaagagcagaaucaccaucagcagagacaccagccacagccaguucagccugacccugaacagccugagcgccgccgacaccgccguguacuacugcggcagaugccaggacggccuggccagcagacccaucgacuucuggggccagggcacccuggugaccgugagcagcgccagcaccaagggc

SEQ ID NO: 34885 - RNA, 381 nt, Artificial Sequence
  derived and/or modified sequence opt4 from anti-HIV_Chain
caggugcagcugguggagagcggcggcggcguggugcagcccggcagaagccugagacugagcugcgccaccagcggcuucaccagcaagaacuacggcgugcacugggugagacaggcccccggcaagggccuggaguggguggccgugaucugguacgacggcagcaacaaguucuacgccgacagcgugaagggcagauucaccaucagcagagacagaagcaagaacaugguguaccugcagaugaacagccugagaguggaggacaccgccaucuacuacugcgccagagacagcguggccuucgugcuggagggccccaucgacuacuggggccagggcacccuggugaccgugagcagcgccagcaccaagggc

SEQ ID NO: 34886 - RNA, 384 nt, Artificial Sequence
  derived and/or modified sequence opt4 from anti-HIV_Chain
caggugcagcuggugcagagcggcggcggcgugaagaagcccggcaccagcgccagcuucagcugcagaaccagcgacgacaucuacgacaacgaguucuucgacagcgccuucaugcacugggugagacugauccccggccagagacccgaguggaugggcuggaugaaccccagaagcggcgccgugaacuacgccagacagcugcagcccagagugagcauguacagagacagagaccugagcaccgccuacauggaguucaagagccugaccagcgccgacaccggcaccuacuucugcgccagaaagaagagaggcgacggcuucaaccuguacuucgaccuguggggcagaggcagccaggugaucgugagcagcgcc

SEQ ID NO: 34887 - RNA, 384 nt, Artificial Sequence
  derived and/or modified sequence opt4 from anti-HIV_Chain
cagggccaccuggugcagagcggcggcggcgugaagaagcugggcaccagcgugaccaucagcugccuggccagcgaggacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugaccagcgccagcaccagc

SEQ ID NO: 34888 - RNA, 384 nt, Artificial Sequence
  derived and/or modified sequence opt4 from anti-HIV_Chain
cagagcgcccugacccagccccccagcgugagcggcgcccccggccagagagugaccaucagcugcagcggcggccccagcaacgugggcggcaacuacguguacugguacagacaguuccccggcaccgcccccaagcugcugauccugagagacgaccagagacccagcggcgugcccgacagauucagcgccagcaagagcggcaacagcgccagccuggccaucagcggccugagacccgacgacgaggccuucuacuucugcgccaccuacgacagccagggcagcuucagaguguucggcggcggcaccgcccugaccgugcugagccagcccaaggccgcccccagcgugacccuguacccccccagcagcgaggag

SEQ ID NO: 34889 - RNA, 384 nt, Artificial Sequence
  derived and/or modified sequence opt4 from anti-HIV_Chain
aacuucaugcugacccagccccccagcgccagcggcacccccggccagagagugaccaucagcugcagcggcggcggcagcaacaucggcggcaaccuggugagcugguaccagcacuuccccggcgccgcccccaagcugcugaucuacagaaacgaccagagacccagcggcgugcccgacagauucagcggcagcaagagcggcaccagcgccagccuggccaucagcggccugagaagcgacgacaaggccaccuacuucugcgccgccuacgacagcacccugagccugagacuguucggcggcggcaccacccugaccgugcugagccagcccaaggccgcccccagcgugacccuguucccccccagcagcgaggag

SEQ ID NO: 34890 - RNA, 384 nt, Artificial Sequence
  derived and/or modified sequence opt4 from anti-HIV_Chain
aacuucaugcugacccagccccccagcgugagcgccacccccggccagaccgugaccaucagcugcagcggcagcggcagcaacgugggcggcaaccacguguacugguacagacagcugcccggcgccgcccccacccuggugaucagcaagaccgaccacagacccagcagagugcccgacagauucagcggcagcaagagcggcaacagcgccagccuggccaucagcggccugagacccgacgacgaggccguguacuucugcgccaccuacgacaccggccugagccugagacuguucggcggcggcaccagacugaccgugcugagccagcccaaggccgcccccagcgugacccaguucccccccagcagcgaggag

SEQ ID NO: 34891 - RNA, 384 nt, Artificial Sequence
  derived and/or modified sequence opt4 from anti-HIV_Chain
cagagcgcccugacccagccccccagcgccagcggcgcccccggccagagagugaccaucagcugcagcggcggccccagcaacgugggcggcaacuacguguacugguacagacaguuccccggcaccgcccccaagcugcugauccugagagacgaccagagacccagcggcgugcccgacagauucagcgccagcaagagcggcaacagcgccagccuggccaucagcggccugagacccgacgacgaggcccuguacuucugcgccaccuacgacagcgacggcagcaucagacuguucggcggcggcaccgcccugaccgugcugagccagcccaaggccgcccccagcgugacccuguucccccccggcugggaggag

SEQ ID NO: 34892 - RNA, 384 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacuguuccagggcagagugagccugaccagacacgccagcugggacuucgacaccuucagcuucuacauggaccugaaggccgugagaagcgacgacaccgccguguacuucugcgccagacagagaagcgacuacugggacuucgacguguggggcagcggcacccaggugaccgugagcagcgccagcaccaagggc

SEQ ID NO: 34893 - RNA, 384 nt, Artificial Sequence
  derived and/or modified sequence opt4 from anti-HIV_Chain
caggugcagcugcugcagagcggcgccguggugaccaagcccggcgccagcgugagagugagcugcgaggccagcggcuacaagaucagagacuacuucauccacugguggagacaggcccccggccagggccugcagugggugggcuggaucaacccccagaccggccagcccaacauccccagacccuuccagggcagagugacccugaccagacacgccagcugggacuucgacaccuucagcuucuacauggaccugaaggcccugagaagcgacgacaccgccaucuacuucugcgccagaagaagaagcgacuacugcgacuucgacguguggggcagcggcacccacgugaccgugagcagcgccagcaccaagggc

SEQ ID NO: 34894 - RNA, 384 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacaguuccagggcagagugagccugaccagacaggccagcugggacuucgacaccaucagcuucuacauggaccugaaggcccugagacuggacgacaccgccguguacuucugcgccagacagagaagcgacuacugggacuucgacguguggggcagcggcacccaggugaccgugagcagcgccagcaccaagggc

SEQ ID NO: 34895 - RNA, 384 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacaguuccagggcagagugagccugaccagacacgccagcugggacuucgacaccuucagcuucuacauggaccugaaggcccugagaagcgacgacaccgccguguacuucugcgccagacagagaagcgacuacugggacuucgacguguggggcagcggcacccaggugaccguguacagcgccagcaccaagggc

SEQ ID NO: 34896 - RNA, 384 nt, Artificial Sequence
  derived and/or modified sequence opt4 from anti-HIV_Chain
caggugcagcugcugcccuucggcggcgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccugccaguuccagggcagagugagccugaccagacccgccagcugggacuucgacaccaucagcuucuacauggaccugaaggcccugagacuggacgacaccgccguguacuucugcgccagacagagaagcgacuacugggacuucgacguguggggcagcggcacccaggugaccgugagcagcgccagcaccaagggc

SEQ ID NO: 34897 - RNA, 384 nt, Artificial Sequence
  derived and/or modified sequence opt4 from anti-HIV_Chain
caggugcaccugagccagagcggcgccgccgugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagagugagccugaccagacaggccagcugggacuucgacaccuacagcuucuacauggaccugaaggcccugagaagcgacgacaccgccaucuacuucugcgccagacagagaagcgacuucugggacuucgacguguggggcagcggcacccaggugaccgugagcagcgccagcaccaagggc

SEQ ID NO: 34898 - RNA, 384 nt, Artificial Sequence
  derived and/or modified sequence opt4 from anti-HIV_Chain
caggugcaccugagccagagcggcgccgccgugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagagugagccugaccagacaggccagcugggacuucgacaccuacagcuucuacauggaccugaaggccgugagaagcgacgacaccgccaucuacuucugcgccagacagagaagcgacuucugggacuucgacguguggggcagcggcacccaggugaccgugagcagcgccagcaccaagggc

SEQ ID NO: 34899 - RNA, 384 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagaaucagccugaccagacaggccagcugggacuucgacaccuucagcuucuacauggaccugaaggcccugagaagcgacgacaccgccguguacuucugcgccagacagagaagcgacuacugggacuucgacguguggggcagcggcacccaggugaccgugagcagcgccagcaccaagggc

SEQ ID NO: 34900 - RNA, 384 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacaguuccagggcagagugagccugaccagacacgccagcugggacuucgacaccuucagcuucuacauggaccugaagggccugagaagcgacgacaccgccaucuacuucugcgccagacagagaagcgacuacugggacuucgacguguggggcagcggcacccaggugaccgugagcagcgccagcaccaagggc

SEQ ID NO: 34901 - RNA, 384 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacaguuccagggcagagugagccugaccagacacgccagcugggacuucgacaccuucagcuucuacauggaccugaaggcccugagaagcgacgacaccgccguguacuucugcgccagacagagaagcgacuacugggacuucgacguguggggcagcggcacccaggugaccgugagcagcgccagcaccaagggc

SEQ ID NO: 34902 - RNA, 384 nt, Artificial Sequence
  derived and/or modified sequence opt4 from anti-HIV_Chain
cacgugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacaguuccagggcagagugagccugaccagacaggccagcugggacuucgacaccuucagcuucuacauggaccugaaggcccugagacuggacgacaccgccaucuacuucugcgccagacagagaagcgacuacugggacuucgacguguggggcagcggcacccaggugaccgugagcagcgccagcaccaagggc

SEQ ID NO: 34903 - RNA, 384 nt, Artificial Sequence
  derived and/or modified sequence opt4 from anti-HIV_Chain
caggugcaccugagccacagcggcgccgccgugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagaaucagccugaccagacaggccagcugggacuucgacaccuucagcuucuacauggaccugaaggcccugagaagcgacgacaccgccguguacuucugcgccagacagagaagcgacuacugggacuucgacguguggggcagcggcacccaggugaccgugagcagcgccagcaccaagggc

SEQ ID NO: 34904 - RNA, 384 nt, Artificial Sequence
  derived and/or modified sequence opt4 from anti-HIV_Chain
caggugcaccugagccagagcggcgccguggugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagaaucagccugaccagacaggccagcugggacuucgacaccuucagcuucuacauggaccugaaggcccugagaagcgacgacaccgccguguacuucugcgccagacagagaagcgacuacugggacuucgacguguggggcagcggcacccaggugaccgugagcagcgccagcaccaagggc

SEQ ID NO: 34905 - RNA, 384 nt, Artificial Sequence
  derived and/or modified sequence opt4 from anti-HIV_Chain
caggugcaccugagccagagcggcgccguggugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagaaucagccugaccagacaggccagcugggacaucgacaccuucagcuucuacauggaccugaaggcccugagaagcgacgacaccgccguguacuucugcgccagacacagaagcgacuacugggacuucgacguguggggcagcggcacccaggugaccgugagcagcgccagcaccaagggc

SEQ ID NO: 34906 - RNA, 384 nt, Artificial Sequence
  derived and/or modified sequence opt4 from anti-HIV_Chain
caggugcaccugagccagagcggcgccguggugaccaagcccggcgccagcgugagagugagcugcgaggccagcggcuacaagaucagcgaccacuucauccacugguggagacaggcccccggccagggccugcagugggugggcuggaucaaccccaagaccggccagcccaacauccccagacaguuccagggcagaaucagccugaccagacaggccagcggcgacuucgacaccuucagcuucuacauggaccugaaggcccugagaagcgacgacaccgccguguacuucugcgccagacagagaagcgacuacugggacuucggcguguggggcagcggcacccaggugaccgugagcagcgccagcaccaagggc

SEQ ID NO: 34907 - RNA, 384 nt, Artificial Sequence
  derived and/or modified sequence opt4 from anti-HIV_Chain
caggugcaccugagccagagcggcgccguggugaccaagcccggcgccagcgugagagugagcugcgaggccagcggcuacaagaucagcggccacuucauccacugguggagacaggcccccggccagggccugcagugggugggcuggaucaaccccaagaccggccagcccaacaaccccagacaguuccagggcagaaucagccugaccagacaggccagcugggacuucgacaccuucagcuucuacauggaccugaaggcccugagaagcgacgacaccgccguguacuucugcgccagacacagaagcgacuacugggacuucgacguguggggcagcggcacccaggugaccgugagcagcgccagcaccaagggc

SEQ ID NO: 34908 - RNA, 384 nt, Artificial Sequence
  derived and/or modified sequence opt4 from anti-HIV_Chain
caggugcaccugagccagagcggcgccgccgugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagaaucagccugaccagacaggccagcugggacuucgacaccuucagcuucuacauggaccugaaggcccugagaagcgacgacaccgccguguacuucugcgccagacacagaagcgacuacugggacuucgacguguggggcagcggcacccaggugaccgugagcagcgccagcaccaagggc

SEQ ID NO: 34909 - RNA, 384 nt, Artificial Sequence
  derived and/or modified sequence opt4 from anti-HIV_Chain
caggugcaccugagccagagcggcgccgccgugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagagugagccugaccagacaggccagcugggacuucgacaccuacagcuucuacaugggccugaaggccgugagaagcgacgacaccgccaucuacuucugcgccagacagagaagcgacuucugggacuucgacguguggggcagcggcacccaggugaccgugagcagcgccagcaccaagggc

SEQ ID NO: 34910 - RNA, 384 nt, Artificial Sequence
  derived and/or modified sequence opt4 from anti-HIV_Chain
caggugcaccugagccagagcggcgccguggugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagaaucagccugaccagacaggccagcugggacuucgacaccuucagcuucuacauggaccugaaggcccugagaagcgacgacaccgccguguacuucugcgccagacacagaagcgacuacugggacuucgacguguggggcagcggcacccaggugaccgugagcagcgccagcaccaagggc

SEQ ID NO: 34911 - RNA, 384 nt, Artificial Sequence
  derived and/or modified sequence opt4 from anti-HIV_Chain
caggugcaccugagccagagcggcgccguggugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagaaucagccugaccagacaggccagcugggacuucgacaccuucagcuucuacauggaccuggaggcccugagaagcgacgacaccgccguguacuucugcgccagacagagaagcgacuacugggacuucgacguguggggcagcggcacccaggugaccgugagcagcgccagcaccaagggc

SEQ ID NO: 34912 - RNA, 384 nt, Artificial Sequence
  derived and/or modified sequence opt4 from anti-HIV_Chain
caggugcaccugagccagagcggcgccgccgugaccaagcccggcgccagcgugagagugagcugcgaggccagcggcuacaagaucagagacuacagcauccacugguggagacaggcccccggccagggccugcagugggugggcuggaucaacccccagaccggccagcccaacauccccagacccuuccagggcagaaucagccugaccagacaggccagcugggacuucgacaccuucagcuucuacauggaccuggaggcccugagaagcgacgacaccgccguguacuucugcgccagacagagaagcgacuacugggacuucgacguguggggcagcggcacccaggugaccgugagcagcgccagcaccaagggc

SEQ ID NO: 34913 - RNA, 384 nt, Artificial Sequence
  derived and/or modified sequence opt4 from anti-HIV_Chain
caggugcaccugagccagagcggcgccgccgugaccaagcccggcgccagcgugagagugagcugcgaggccagcggcuacaagaucagcgaccacuucauccacugguggagacaggcccccggccagggccugcagugggugggcuggaucaaccccaagaccggccagcccaacaaccccagacaguuccagggcagaaucagccugaccagacaggccagcugggacuucgacaccuucagcuucuacauggaccugaaggcccugagaagcgacgacaccgccguguacuucugcgccagacagagaagcgacuacagagacuucgacguguggggcagcggcacccaggugaccgugagcagcgccagcaccaagggc

SEQ ID NO: 34914 - RNA, 384 nt, Artificial Sequence
  derived and/or modified sequence opt4 from anti-HIV_Chain
caggugcaccugagccagagcggcgccguggugaccaagcccggcgccagcgugagagugagcugcgaggccagcggcuacaagaucagcgaccacuucauccacugguggagacaggcccccggccagggcccccagugggugggcuggaucaaccccaagaccggccagcccaacaaccccagacaguuccagggcagaaucagccugaccagacaggccagcugggacuucgacaccuucagcuucuacauggaccugaaggcccugagaagcgacgacaccgccguguacuucugcgccagacacagaagcgacuacugggacuucgacguguggggcagcggcacccaggugaccgugagcagcgccagcaccaagggc

SEQ ID NO: 34915 - RNA, 384 nt, Artificial Sequence
  derived and/or modified sequence opt4 from anti-HIV_Chain
caggugagacugcugcagagcggcgccgccgugaccaagcccggcgccagcgugagagugagcugcgaggccagcggcuacgagaucagagacuacuucauccacugguggagacaggcccccggccagggccugcagugggugggcuggaucaaccccaagaccggccagcccaacaaccccagacaguuccagggcagagugagccugaccagacaggccagcugggacuucgacagcuacagcuucuacauggaccugaaggcccugagaagcgacgacaccgccguguacuucugcgccagacagagaagcgacuacugggacuucgacguguggggcagcggcacccaggugaccgugagcagcgccagcaccaagggc

SEQ ID NO: 34916 - RNA, 384 nt, Artificial Sequence
  derived and/or modified sequence opt4 from anti-HIV_Chain
caggugagacugcugcagagcggcgccgccgugaccaagcccggcgccagcgugagagugagcugcgaggccagcggcuacgagaucagagacuacuucauccacugguggagacaggcccccggccagggccugcagugggugggcuggaucaaccccaagaccggccagcccaacaaccccagacaguuccagggcagagugagccugaccagacaggccagcugggacuucgacagcuacagcuucuacauggaccugaaggcccugagaagcgacgacaccggcguguacuucugcgccagacagagaagcgacuacugggacuucgacguguggggcagcggcacccaggugaccgugagcagcgccagcaccaagggc

SEQ ID NO: 34917 - RNA, 384 nt, Artificial Sequence
  derived and/or modified sequence opt4 from anti-HIV_Chain
caggugagacugcugcagagcggcgccgccgugaccaagcccggcgccagcgugagagugagcugcgaggccagcggcuacgagaucagagacuacuucauccacugguggagacaggcccccggccagggccugcagugggugggcuggaucaaccccaagaccggccagcccaacaaccccagacaguuccagggcagagugagccugaccagacaggccagcugggacuucgacagcuacagcuucuacauggaccugaaggcccugagaagcgacgacaccgccguguacuucugcgccagacagagaagcgacuacugggacuucgacguguggggcagcggcagccaggugaccgugagcagcgccagcaccaagggc

SEQ ID NO: 34918 - RNA, 384 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccugccaguuccagggcagagugagccugaccagacaggccagcugggacuucgacaccaucagcuucuacauggaccugaaggcccugagacuggacgacaccgccguguacuucugcgccagacagagaagcgacuacugggacuucgacguguggggcagcggcacccaggugaccgugagcagcgccagcaccaagggc

SEQ ID NO: 34919 - RNA, 384 nt, Artificial Sequence
  derived and/or modified sequence opt4 from anti-HIV_Chain
caggugcagcugcugcagagcggcgccgccgugaccaagcccggcgccagcgugagagugagcugcgaggccagcggcuacaacaucagagacuacuucauccacugguggagacaggcccccggccagggccugcagugggugggcuggaucaaccccaagaccggccagcccaacaaccccagacaguuccagggcagagugagccugaccagacacgccagcugggacuucgacaccuucagcuucuacauggaccugaaggcccugagaagcgacgacaccgccguguacuucugcgccagacagagaagcgacuacugggacuucgacguguggggcagcggcacccaggugaucgugagcagcgccagcaccaagggc

SEQ ID NO: 34920 - RNA, 384 nt, Artificial Sequence
  derived and/or modified sequence opt4 from anti-HIV_Chain
caggugcagcuggugcagagcggcgccgacgugaagaagcccggcgccaccgugaccgugagcugcaagaccgacgaggacgaggacgacuucagagcccaccugaugcaguggaugagacaggcccccggccagagacuggagugggugggcuggaucaagccccagaccggccagcccagcuacggccagaaguuccagggcagagugacccugaccagagaggugagcaccagcaccguguuccugcagcugagaaaccugagaagcgacgacaccgccguguacuacugcgccagacccagaggcggcagagacaacuggagcuuccacguguggggcagaggcacccuggugaccgugagcagcgccagcaccaagggc

SEQ ID NO: 34921 - RNA, 384 nt, Artificial Sequence
  derived and/or modified sequence opt4 from anti-HIV_Chain
gaggugcagcugguggagagcggcgccgaggugaagaagcccggcgccagcgugaaggugagcugcaaggugagcggcaacagccugaccgaguucagcauccacugggugagacaggcccccggcaagggccuggaguggaugggcggcuucgaccccgaggagggcgagaccgugcccgcccagaaguucaagggcagacugaccaugaccgaggacaccagcaccaacaccgccuacauggagcugagcagccugagaagcgaggacaccgccguguacuacugcagcaccgagcccagagagaugggcacccugaccgccggcuucgaguacuggggccagggcacccuggugaccgugagcagcgccagcaccaagggc

SEQ ID NO: 34922 - RNA, 384 nt, Artificial Sequence
  derived and/or modified sequence opt4 from anti-HIV_Chain
agagugcagcugggccagagcggcgccgaggugaagaagcccggcgccagcgugaaggugagcugcaaggugagcggcaacagccugaccgaguucagcauccacugggugagacaggcccccggcaagggccuggaguggaugggcggcuucgaccccgaggagggcgagaccgugcccgcccagaaguucaagggcagagugaccaugaccgaggacaccagcaccaacaccgccuacauggagcugagcagccugagaagcgaggacaccgccguguacuacugcagcaccgagcccagagagaugggcacccugaccgccggcuucgaguacuggggccagggcacccuggugaucgugagcagcgccagcaccaagggc

SEQ ID NO: 34923 - RNA, 384 nt, Artificial Sequence
  derived and/or modified sequence opt4 from anti-HIV_Chain
caggugcagcuggugcagagcggcgccgacgugaagaagcccggcgccagcgugaccgugagcugcaagaccgacgaggacgaggacgacuucagagcccaccuggugcaguggaugagacaggcccccggccagagacuggagugggugggcuggaucaagccccagaccggccagcccagcuacgcccagaaguuccagggcagagugacccugaccagagaggugagcaccagcaccguguuccugcagcugagaaaccugagaagcgacgacaccgccguguacuacugcgccagacccagaggcggcagagacaacuggagcuuccacguguggggcagaggcacccuggugaccgugagcagcgccagcaccaagggc

SEQ ID NO: 34924 - RNA, 384 nt, Artificial Sequence
  derived and/or modified sequence opt4 from anti-HIV_Chain
caggugcagcugcaggagagcggccccggccuggugaagcccagcgagacccugagccugaccugcagcgugagcggcgccagcaucagcaacuucuacuggaccuggaucagacagcccgccggcaagggccuggagugggugggcagacuguacagcagcgacagaaccaacuacaaccccagccugaacggcagagugaccaugagccuggacaccagcaagaaccaguucagccugagacugaccagcaugaccgacgccgacaccgccaucuacuucugcgccagagagaagggccaguggcugaccgugccccccuacuacuucgacagcuggggccagggcauccuggugaccgugagcagcgccagcaccaagggc

SEQ ID NO: 34925 - RNA, 384 nt, Artificial Sequence
  derived and/or modified sequence opt4 from anti-HIV_Chain
caggugcagcuggugcagagcggcgccgaggugagaaagcccggcgccagcgugaaggugagcugcaagaccagcggcuacaccuucaccaacagcuacauccacugggugagacaggcccccggccagggccuggaguggaugggcaucaucaacccccccggcggcaacaccuacuacgcccagaaguuccacggcagagugacccugaccagagacaccagcaccagcaccguguacauggagcugaacagccugagaagcgaggacaccgccguguacuucugcgccagaccccacagccccaccaacauccccagcagaccccuggacuacuggggccagggcacccuggugaccgugagcagcgccagcaccaagggc

SEQ ID NO: 34926 - RNA, 384 nt, Artificial Sequence
  derived and/or modified sequence opt4 from anti-HIV_Chain
caggugcagcugcaggagagcggccccggccuggugaagcccagcggcacccugagccugaccugcaacguguacggcggcagcaugaucagcuacuacuggagcuggaucagacagccccccggcaagggccuggaguggaucggccacguguacaacagcggcaacaccaaguacagccccagccugaagaacagagugaccaucagcauggacaccagcagaaaccuguucagccugaaggugaccagcgugacccccgccgacaccgccguguacuacugcgccagagccgacuacgacaacaucugggacagcagaggcggcuucgaccuguggggccagggcacccuggugaccgugagcagcgccagcaccaagggc

SEQ ID NO: 34927 - RNA, 384 nt, Artificial Sequence
  derived and/or modified sequence opt4 from anti-HIV_Chain
caggugcagcuggugcagagcggcgccgaggugaagaagcccggcagcagcgugaaggugagcugcaaggccagcggcggcacccugagcagcuacaccaucagcugggugagacaggcccccggccagggccuggaguggaugggcagacugaucccccugguggacaucaccaccuacgcccagaaguuccagggcagagugaccaucaccgccgacaccagcaccaacaccgccuacauggagcugagcaaccugagaagcgaggacaccgccaucuaccacugcgccaccagcaccaugaucgccgccgugaucaacgacgccuucgaccuguggggccagggcaccaccgugaccgugagcagcgccagcaccaagggc

SEQ ID NO: 34928 - RNA, 384 nt, Artificial Sequence
  derived and/or modified sequence opt4 from anti-HIV_Chain
caggugcagcuggugcagagcggcgccgaggugaagaagcccggcgccagcgugaagaucagcugcaaggccagcggcuacagcuucagaaacuacgccgugcacugggugagacaggcccccggccagggccuggaguggaugggcgagaucaacggcggcaacggcaacaccgaguacagccagaagagccagggcagacugaccaucaccagagacaucagcgccaccaccgccuacauggagcugagcagccugagaagcgacgacaccgccguguacuacugcgccagaguggccuacgugcacguggugaccaccagaagccuggacaacuggggccagggcacccuggugaccgugagcagcgccagcaccaagggc

SEQ ID NO: 34929 - RNA, 384 nt, Artificial Sequence
  derived and/or modified sequence opt4 from anti-HIV_Chain
caggugagacugagccagagcggcgccgccgugaugaagaccggcgccagcgugaccaucagcugcgagaccgagggcuucaacuucgugaacuacaucauccacugggugagaagaccccccggcagaggcuucgaguggcugggcaugaucgaccccagaaacggccaccccugguucgcccagaccgugagaggcagacugagccugagaagagacaccuucaacgagaucguguacaugacccugagcggccugaccaccgacgacaccggccuguacuucugcgccagaaacgagccccaguaccacagccugcccggcauguucgacuacuggggccagggcacccccgugaccgugagcagcgccagcaccaagggc

SEQ ID NO: 34930 - RNA, 384 nt, Artificial Sequence
  derived and/or modified sequence opt4 from anti-HIV_Chain
caggugagacugagccagagcggcgccgccguggugaagaccggcgccagcgugaccaucagcugcgagaccgagggcuacaacuucgugaacuacaucauccacugggugagaagaccccccggcagaggcuucgaguggcugggcaugaucgaccccagaaacggccaccccugguucgcccagaccgugagaggcagacugagccugagaagagacaccuucaaggagaccguguacaugacccugagcggccugaccagcgacgacaccggcguguacuucugcgccagaaacgagccccaguaccacagccugcccggcauguucgacuacuggggccacggcacccccgugaccgugagcagcgccagcaccaagggc

SEQ ID NO: 34931 - RNA, 384 nt, Artificial Sequence
  derived and/or modified sequence opt4 from anti-HIV_Chain
cagggccagcuggugcagagcggcggcggcgugaagaagcugggcaccagcgugaccaucagcugccuggccagcgaguacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugaccagcgccagcaccagc

SEQ ID NO: 34932 - RNA, 384 nt, Artificial Sequence
  derived and/or modified sequence opt4 from anti-HIV_Chain
caggugcagcuggugcagagcggcgccgaggugaagaagcccggcgccagcgugaaggugagcugcaaggccagcggcuacaccuucaccagcuacgacaucaacugggugagacaggccaccggccagggccuggaguggaugggcuggaugaaccccaacagcggcaacaccggcuacgcccagaccuuccagggcagagugaccaugaccagaaacaccagcaucagcaccgccuacauggagcugagcagccugagaagcgaggacaccgccguguacuacugcgccagagacagauggcugccccaguacuacuacuacggcauggacguguggggccagggcaccaccgugaccgugagcagcgccagcaccaagggc

SEQ ID NO: 34933 - RNA, 384 nt, Artificial Sequence
  derived and/or modified sequence opt4 from anti-HIV_Chain
caggugcagcuggugcagagcggcgccgaggugaagaagcccggcagcagcaugaaggugagcugcaagagcagcggcggcaccuucagcaaccacgccaucagcugggugagacaggcccccggcaagggccuggaguggaugggcggcaucauccccaugagcggcaccaccaacuaccugcagaaguuccagggcagagugaccaucaccgccgacgaguucgccaccaccgccuacauggagcugagcagccugaccagcgaggacaccgccguguacuacugcgccagagccagagccgacagccacacccccaucgacgccuucgacaucuggggccccggcaccagagugaucgugagcagcgccagcaccaagggc

SEQ ID NO: 34934 - RNA, 384 nt, Artificial Sequence
  derived and/or modified sequence opt4 from anti-HIV_Chain
caggugcagcuggugcagagcggcgccgaggugaagaagcccggcgccagcgugaaggugagcugcaaggugagcggcuacacccugaccgagcugagcauccacugggugagacaggcccccggcaagagacuggaguggaugggcggcuucgaccccgaggacggcgagagaaucuacgcccagaaguuccagggcagagugaccaugaccgaggacaccagcaccgacaccgccuacauggagcugaacagccugagaagcgacgacaccgccguguacuacugcgccaccggcggccuguacugcagcagcaucagcugcaucauggacguguggggccagggcaccaccgugaccgugagcagcgccagcaccaagggc

SEQ ID NO: 34935 - RNA, 384 nt, Artificial Sequence
  derived and/or modified sequence opt4 from anti-HIV_Chain
caggugcagcuggugcagagcggcgccgaggugaagaugcccggcgccagcgugaaggugagcugcaaggugagcggcuacagccugaccgagcugagcauccacugggugagacaggcccccggcaagagacuggaguggaugggcggcuucgaccccgaggacgacgagagaaucuacgcccagaaguuccaggacagagugaccaugaccgaggacaccagcaccgacaccgccuacauggaccugaacagccugagaagcgaggacaccgccguguacuacugcaccaccggcggccuguacugcagcagcaucagcugcaucauggacguguggggccagggcaccaccgugaucgugagcagcgccagcaccaagggc

SEQ ID NO: 34936 - RNA, 387 nt, Artificial Sequence
  derived and/or modified sequence opt4 from anti-HIV_Chain
gaggugcagcugagcgagagcggcggcggcuucgugaagcccggcggcagccugagacugagcugcgaggccagcggcuucaccuucaacaacuacgccaugagcugggugagacaggcccccggcaagggccuggagugggugagcgugaccagcgcccacggcggcagcgccuacuacggcgaguucgugaagggcagauucaccaugagcagagaccacuucaucgacaccguguaccuggagaugaacggccugaccguggaggacaccgccguguacuacugcgugagagugaccuucuaccacgagggcagcggcuacuacuacagagccggcaacuacuucgacagcuggggcaagggcaccagagugguggugagcgcc

SEQ ID NO: 34937 - RNA, 387 nt, Artificial Sequence
  derived and/or modified sequence opt4 from anti-HIV_Chain
gaggugcagcugagcgagagcggcggcggcuucgugaagcccggcggcagccugagacugagcugcgaggccagcggcuucaccuucaacaacuacgccaugagcugggugagacaggcccccggcaagggccuggagugggugagcgugaccagcgcccacggcggcagcgccuacuacggcgaguucgugaagggcagauucaccaugagcagagaccacuucaucgacaccguguaccuggagaugaacagacugaccguggaggacaccgccguguacuacugcgugagagugaccuucuaccacgagggcagcggcuacuacuacagagccggcaacuacuucgacagcuggggcaagggcaccagagugguggugagcgcc

SEQ ID NO: 34938 - RNA, 387 nt, Artificial Sequence
  derived and/or modified sequence opt4 from anti-HIV_Chain
gaggugcagcugagcgagagcggcggcggcguggugaagcccggcggcagccugagacugagcugcgaggccagcggcuucaccuucagcaacuacgccaugagcugggugagacaggcccccggcaagggccuggagugggugagcgugaccggcggccacggcaccuacggcuacuacggcgaguucgugaagggcagauucaccaucagcagagaccacagcauggacaccguguaccugcagaugaacagacugagaguggaggacaccgccguguacuacugcgugagaacccccuacuaccacgagagcagcggcuacuacuacagagccggcaacuacuucgacuucuggggcaagggcacccuggugaucgugagcgcc

SEQ ID NO: 34939 - RNA, 387 nt, Artificial Sequence
  derived and/or modified sequence opt4 from anti-HIV_Chain
gaggugcagcugagcgagagcggcggcggcuucgugaagcccggcggcagccugagacugagcugcgaggccagcggcuucaccuucaacaacuacgccaugggcugggugagacaggcccccggcaagggccuggagugggugagcgugaccagcgcccacggcggcagcgccuacuucggcgaguucgugaagggcagauucaccaugagcagagaccacuucaucgacaccguguaccuggagaugaacagacugaccguggaggacaccgccguguacuacugcgugagagugaccuucuaccacgagggcagcggcuacuacuacagagccggcaacuacuucgacagcuggggccagggcacccuggugaucgugagcgcc

SEQ ID NO: 34940 - RNA, 387 nt, Artificial Sequence
  derived and/or modified sequence opt4 from anti-HIV_Chain
caggugcagcugguggagagcggcggcggccuggugcagcccggcggcagccugagacugagcugcgccgccagcggcuucaccuucagcacccacuggaugcacugggugagacaggcccccggcaagggccuggugugggugagcagaauccacagcgacggcagaagcaccagcuacgccgacagcgugaagggcagauucaccaucagcagagacaacgccaagaacacccuguaccugcagaugaacagccugagagccgaggacaccgccguguacuacugcgccagaggcgccgccguguucggcguggugaucaucggcggcauggaccuguggggccagggcaccaccgugaccgugagcagcgccagcaccaagggc

SEQ ID NO: 34941 - RNA, 387 nt, Artificial Sequence
  derived and/or modified sequence opt4 from anti-HIV_Chain
caggugcagcugguggagagcggcggcgcccuggugcagcccggcggcagccugagacugagcugcgccgccagcggcuucagcuucagcagcuacgccaugagcugggugagacaggcccccggcaagggccuggagugggugagcgccaucagcagaagcggcggcagcaccuacuacgccgacagcgugaagggcagauucaccaucagcaucgacaacagcaacaacacccuguaccugcagaugaacagccugagaguggaggacaccgccguguacuacugcgccaagagagaggccuucuacuacggcgccggcggcuacggcauggacguguggggccagggcaccaccgugaccgugagcagcgccagcaccaagggc

SEQ ID NO: 34942 - RNA, 387 nt, Artificial Sequence
  derived and/or modified sequence opt4 from anti-HIV_Chain
uuccagggccaccuggugcagagcggcggcggcgugaagaagcccggcaccagcgugacccugagcugccuggccagcgaguacaccuucaccgaguucaccauccacuggaucagacaggcccccggccagggcccccuguggcugggccugaucaagagaagcggcagacugaugaccagcuacagauuccaggacagacugagccugagaagagacagaagcaccggcaccguguucauggagcugagaagccugagaaccgacgacaccgccguguacuacugcgccagagacggccugggcgagcuggcccccgccuaccacuacggcaucgacgccuggggccagggcaccaccgugaucgugaccagcgccagcaccagc

SEQ ID NO: 34943 - RNA, 387 nt, Artificial Sequence
  derived and/or modified sequence opt4 from anti-HIV_Chain
cagggccugcuggugcagagcggcggcggcgugaagaagcugggcaccagcgugaccaucagcugccuggccagcgaguacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugaccagcgccagcaccaagggc

SEQ ID NO: 34944 - RNA, 387 nt, Artificial Sequence
  derived and/or modified sequence opt4 from anti-HIV_Chain
aacuucaugcugacccagcccgccagcgugagcggcagccccggccagagcaucaccaucagcugcagcggcaccggcagcgacaucggcguguacaacuacgugagcugguaccagcagcaccccggcaaggcccccagacugaugaucuacgacgugaccaacagacccagcggcgugagcaacagauucagcggcagcaagagcggcuucaccgccagccugaccaucagcggccugcagggcgacgacgaggccgacuacuacugcagcagcuacagcagcaccaacaccuacguguucggcaccggcacccacgugaccgugcugggccagcccaaggccaaccccaccgugacccuguucccccccagcagcgaggagcug

SEQ ID NO: 34945 - RNA, 387 nt, Artificial Sequence
  derived and/or modified sequence opt4 from anti-HIV_Chain
cagagcgcccugacccagcccagaagcgugagcggcagccccggccagagcgugaccaucagcugcaccggcaccagcagcgacgugggcgccuacaacuacgugagcugguacagacagcaccccggcaaggcccccaagcugaugaucaacgacgugagcaagagacccagcggcgugcccgacagauucagcggcagcaagagcggcaacaccgccagccugaccaucagcggccugcaggccgaggacgaggccgacuacuacugcugcagcuacgccggcaccuacagcuacguguucggcaccggcaccaaggugaccgugcugggccagcccaaggccaaccccaccgugacccuguucccccccagcagcgaggagcug

SEQ ID NO: 34946 - RNA, 387 nt, Artificial Sequence
  derived and/or modified sequence opt4 from anti-HIV_Chain
cagggccagcuggugcagagcggcggcggccugaagaagcccggcaccagcgugaccaucagcugccuggccagcgaguacaccuucaacgaguucgugauccacuggaucagacaggcccccggccagggcccccuguggcugggccugaucaagagaagcggcagacugaugaccgccuacaacuuccaggacagacugagccugagaagagacagaagcaccggcaccguguucauggagcugagaggccugagacccgacgacaccgccguguacuacugcgccagagacggccugggcgagguggcccccgacuacagauacggcaucgacguguggggccagggcagcaccgugaucgugaccgccgccagcaccaagggc

SEQ ID NO: 34947 - RNA, 387 nt, Artificial Sequence
  derived and/or modified sequence opt4 from anti-HIV_Chain
aacuucaugcugacccagccccccagcgccagcggcgcccccggccagagagugaccaucagcugcagcggcggccccagcaacgugggcggcaacuacguguacugguacagacaguuccccggcaccgcccccaaccugcugauccugagagacgaccagagacccagcggcgugcccgacagauucagcgccagcaagagcggcaacagcgccagccuggccaucagcggccugagacccgacgacgaggccuucuacuucugcgccaccuacgacagcgacggcagcaucagacuguucggcggcggcaccacccugaccgugcugagccagcccaaggccgcccccagcgugacccuguucccccccagcagcgaggagcug

SEQ ID NO: 34948 - RNA, 387 nt, Artificial Sequence
  derived and/or modified sequence opt4 from anti-HIV_Chain
cagcuggugcugacccagccccccagcgugagcggcgcccccggccagagagugaccaucagcugcagcggcggccccagcaacgugggcggcaaccugguguacugguacaagcaguuccccggcaccgcccccaagcugcugaucagaagagacgaccagagacccagcggcgugcccgacagauucagcggcagcaagagcggcaacagcgccagccugaccaucagcggccugagacccgacgacgaggccuucuacuucugcgccaccuacgacagccagggcagcaccagacuguucggcggcggcaccgugcugaccgugcugagccagcccaaggccgcccccagcgugacccuguucccccccagcagcgaggagcug

SEQ ID NO: 34949 - RNA, 387 nt, Artificial Sequence
  derived and/or modified sequence opt4 from anti-HIV_Chain
aacuucaugcugacccagccccccagcgugagcggcgcccccggccagagagugaccaucagcugcagcggcggccccagcaacgugggcggcaaccugguguacugguacaagcaguuccccggcaccgcccccaagcugcugaucagaagagacgaccagagacccagcggcgugcccgacagauucagcggcagcaagagcggcaacagcgccagccuggccaucagcggccugagacccgacgacgaggccuucuacuucugcgccaccuacgacagccacggcagcaucagacuguucggcggcggcacccugcugaccgugcugagccagcccaaggccgcccccagcgugacccuguucccccccagcagcgaggagcug

SEQ ID NO: 34950 - RNA, 387 nt, Artificial Sequence
  derived and/or modified sequence opt4 from anti-HIV_Chain
cagagcgcccugaccagaacccccagcgugagcggcgcccccggccagagagugaccaucagcugcagcggcggccccagcaacgugggcggcaacuacguguacugguaccagcaguuccccggcgccgcccccaagcugcugaucagaagagacgaccagagacccagcggcgugcccgacagauucagcggcagcaagagcggcaacagcgccagccuggccaucagcggccugagacuggacgacgaggccuacuacuucugcgccaccuacgacagcggcuggagcaucagacuguucggcggcggcaccagacugaccgugcugagccagcccaaggccgcccccagcgugacccuguucccccccagcagcgaggagcug

SEQ ID NO: 34951 - RNA, 387 nt, Artificial Sequence
  derived and/or modified sequence opt4 from anti-HIV_Chain
cagagcgcccugacccagccccccagcgugagcgccacccccggccagaccgugaccaucagcugcagcggcagcggcagcaacgugggcggcaaccacguguacugguacagacagcugcccggcgccgcccccacccugcugaucagcaagaccgaccacagacccagcagagugcccgacagauucagcgccagcaagagcggcaacagcgccagccuggccaucagcggccugagacccgacgacgaggccaucuacuucugcgccaccuacgacaccggccugagccugagacuguucggcggcggcaccagacugaccgugcugagccagcccaaggccgcccccagcgugacccuguucccccccagcagcgaggagcug

SEQ ID NO: 34952 - RNA, 387 nt, Artificial Sequence
  derived and/or modified sequence opt4 from anti-HIV_Chain
caggugcagcugcuggagagcggccccggccuggugacccccagcggcacccugagccuggccugcgccgugagcggcgccagcaucagcagcagccacugguggaccugggugagacagagccccggcaagggccuggaguggaucggcgagaucgacagaagaggcaccaccaacuacaaccccagccugagaagcagagugaccauccugcuggacaacagcaagaaccaguucagccugagccugagaagcgugaccgccgccgacaccgccguguacuacugcaccaagguguacgccggccuguucaacgagagaaccuacggcauggacguguggggccacggcaccaccgugcuggugagcagcgccagcaccaagggc

SEQ ID NO: 34953 - RNA, 387 nt, Artificial Sequence
  derived and/or modified sequence opt4 from anti-HIV_Chain
caggccguggugacccagccccccagcgugagcgccacccccggccagaccgugaccaucagcugcagcggcagcggcagcaacgugggcggcaaccacguguacugguacagacagcugcccggcgccgcccccacccugcugaucagcaagaccaacagaagacccagccaggugcccgacagauucagcggcagcaagagcggcaacagcgccagccuggccaucagcggccugagacccgacgacgaggccgacuacuucugcgccaccuacgacaccgaccugagccugagacuguucggcggcggcaccagacugaccgugcugagccagcccaaggccgcccccagcgugacccuguucccccccagcagcgaggagcug

SEQ ID NO: 34954 - RNA, 387 nt, Artificial Sequence
  derived and/or modified sequence opt4 from anti-HIV_Chain
cagagcgcccugacccagccccccagcgugagcggcacccccggccagaacgugaccaucagcugcagcggcggcggcagcgacgugggcggcaaccuggugagcugguaccagcacuuccccggcgccgcccccaagcugcugauccacagagacaaccagagacccagcggcgugcccgacagauucagcgcccugaagagcggcaacagcgccagccuggccaucagcggccugagaagcgacgacgaggccuucuacuucugcgccguguacgacagcagccugagccugggccuguucggcggcggcaccaagcugaccgugcugagccagcccaaggccgcccccagcgugacccuguucccccccagcagcgaggagcug

SEQ ID NO: 34955 - RNA, 387 nt, Artificial Sequence
  derived and/or modified sequence opt4 from anti-HIV_Chain
cagagcgcccugacccagccccccagcgccagcggcacccccggccagagagugaccaucagcugcagcggcggcggcagcaacaucggcggcaaccuggugagcugguaccagcacuuccccggcaccgcccccaagcugcugaucuacagaaacgaccagagacccagcggcgugcccgacagauucagcggcagcaagagcggcaccagcgccagccugaccaucagcggccugagaagcgacgacgaggccaccuacuucugcgccgccuacgacagcagccugagccugagacuguucggcggcggcaccacccugaacgugcugagccagcccaaggccgcccccagcgugacccuguucccccccagcagcgaggagcug

SEQ ID NO: 34956 - RNA, 387 nt, Artificial Sequence
  derived and/or modified sequence opt4 from anti-HIV_Chain
cagagcgcccugacccagccccccagcgugagcgccacccccggccagaccgugaccaucagcugcagcggcagcggcagcaacgugggcggcaaccacguguacugguacagacagcugcccggcgccgcccccacccugcugaucagcaagaccaaccacagacccagccaggugcccgacagauucagcgccagcaagagcggcaacagcgccagccuggccaucagcggccugagacccgacgacgaggccgacuacuucugcggcaccuacgacaccagccugagccugagacuguucggcggcggcaccagacugaccgugcugagccagcccaaggccgcccccagcgugacccuguucccccccagcagcgaggagcug

SEQ ID NO: 34957 - RNA, 387 nt, Artificial Sequence
  derived and/or modified sequence opt4 from anti-HIV_Chain
cagagcgugcugacccaggugcugagcgugagcggcacccccggccagagagugaucaucagcugcagcggcaccagcagcaacgugggcggcaaccuggugagcugguaccagcaccugcccggcgccgcccccagacugcugauccacagagacgaccagagacccagcggcgugcccgacagauucagcggcagcaagagcggcaacagcgccagccuggugaucagcggccugagaagcgacgacgaggccgacuacuucugcggcgccuacgacagcaccuucagccugcccguguucggcggcggcaccagacugaccgugcugagccagcccaaggccgcccccagcgugacccuguucccccccagcagcgaggagcug

SEQ ID NO: 34958 - RNA, 387 nt, Artificial Sequence
  derived and/or modified sequence opt4 from anti-HIV_Chain
cagagcgcccugacccagccccccgccaccagcggcacccccggccagagagugaccaucagcugcagcggcggcggcagcaacgugggcggcaaccuggugagcugguaccagcaguuccccggcgccgcccccaagcugauccugcacagagacggccagagacccagcggcgugcccgacagauucagcgccagcaagagcggcaccagcgccagccugaccaucagcggccugagaagcgacgacgaggccaccuacuucugcgccgccuucgacagcgcccugagccugccccuguucggcggcggcaccaagcugaccgugcugagccagcccaaggccgcccccagcgugacccuguucccccccagcagcgaggagcug

SEQ ID NO: 34959 - RNA, 387 nt, Artificial Sequence
  derived and/or modified sequence opt4 from anti-HIV_Chain
cagcuggugcugacccagccccccagcgugagcgccacccccggccagaccgugaccaucagcugcagcggcagcggcagcaacgugggcggcaaccacguguacugguacagacagcugcccggcgccgcccccacccuggugaucagcaagaccgaccacagacccagcagagugcccgacagauucagcggcagcaagagcggcaacagcgccagccuggccaucagcggccugagacccgacgacgaggccgccuacuucugcgccaccuacgacaccggccugagccugagacuguucggcggcggcaccagacuggccgugcugagccagcccaaggccgcccccagcgugacccuguucccccccagcagcgaggagcug

SEQ ID NO: 34960 - RNA, 387 nt, Artificial Sequence
  derived and/or modified sequence opt4 from anti-HIV_Chain
cagagcgcccugacccagccccccagcgugagcggcacccccggccagaacgugaccaucagcugcagcggcggcggcagcaacgugggcggcaaccuggugagcugguaccagcacuuccccggcgccgcccccaagcugcugauccacagagacaaccagagacccagcggcgugcccgacagauucagcgugcugaagagcggcaacagcgccagccuggccaucagcggccccagaagcgacgacgaggccuucuacuucugcgccguguacgacagcagccugagccugggccuguucggcggcggcaccaagcugaccgugcugagccagcccaaggccgcccccagcgugacccuguucccccccagcagcgaggagcug

SEQ ID NO: 34961 - RNA, 387 nt, Artificial Sequence
  derived and/or modified sequence opt4 from anti-HIV_Chain
cagaccguggugacccagccccccagcgccagcggcacccccggccagagagugaccaucagcugcagcggcggcggcagcaacaucggcggcaaccuggugagcugguaccagcacuuccccggcgccgcccccaagcugcugaucuacagaaacgaccagagacccagcggcgugcccgacagauucagcggcagcaagagcggcaccagcgccagccugaccaucagcggccugagaagcgacgacgaggccaccuacuucugcgccgccuacgacugcacccugagccugagacuguucggcggcggcaccacccugaacgugcugagccagcccaaggccgcccccagcgugacccuguucccccccagcagcgaggagcug

SEQ ID NO: 34962 - RNA, 387 nt, Artificial Sequence
  derived and/or modified sequence opt4 from anti-HIV_Chain
cagagcgcccugacccagacccccagcgugagcggcgcccccggccagagagugaccaucagcugcagcggcggccccagcaacgugggcggcaacuacguguacugguaccagcaguuccccggcgccgcccccaagcugcugaucagaagagacgaccagagacccagcggcgugcccgacagauucagcggcagcaagagcggcaacagcgccagccuggccaucagcggccugagacuggacgacgaggccuacuacuucugcgccaccuacgacagcggcuggagcaucagacuguucggcggcggcaccagacugaccgugcugagccagcccaaggccgcccccagcgugacccuguucccccccagcagcgaggagcug

SEQ ID NO: 34963 - RNA, 387 nt, Artificial Sequence
  derived and/or modified sequence opt4 from anti-HIV_Chain
cagagcgugcugacccagccccccagcgccagcggcgcccccggccagagagugaccaucagcugcagcggcggccccagcaacgugggcggcaacuacguguacugguacagacaguuccccggcaccgcccccaaccugcugauccugagagacgaccagagacccagcggcgugcccgacagauucagcgccagcaagagcggcaacagcgccagccuggccaucagcggccugagacccgacgacgaggccuucuacuucugcgccaccuacgacagcgacggcagcgugagacuguucggcggcggcaccacccugaccgugcugagccagcccaaggccgcccccagcgugacccuguucccccccagcaacggcggcaga

SEQ ID NO: 34964 - RNA, 387 nt, Artificial Sequence
  derived and/or modified sequence opt4 from anti-HIV_Chain
cagggccagcuggugcagagcggcggcggcgugaagaagcccggcaccagcgugaccaucagcugccuggccagcgaguacaccuucaacgaguucgugauccacuggaucagacaggcccccggccagggcccccuguggcugggccugaucaagagaagcggcagacugaugaccagcuacaaguuccaggacagacugaaccugagaagagacagaagcaccggcaccguguucauggagcugagaggccugagacccgacgacaccgccguguacuacugcgccagagacggccugggcgagguggcccccgacuacagauacggcaucgacguguggggccagggcagcaccgugaucgugaccgccgccagcaccaagggc

SEQ ID NO: 34965 - RNA, 387 nt, Artificial Sequence
  derived and/or modified sequence opt4 from anti-HIV_Chain
gaggugcagcugguggagagcggcgccgaggugaagaagcccggcgccagcgugaagguggccugcaaggugagcggcaagaagcugagcgaccugagcauccacugggugagacaggcccccggcaagggccuggaguggaugggcggcuucgacgaggaggacggcaagaucagcuacgagagaaaguuccagggcagagugaccaugaccgaggacaccgccagagacaccgccuucauggagaugagcagccugagaagcgacgacaccgccguguacuucugcgccgccgcccccagacuggaccugggcgagcugagcagcggcuuccacuucuggggccugggcacccuggugagcgugagcagcgccagcaccaagggc

SEQ ID NO: 34966 - RNA, 387 nt, Artificial Sequence
  derived and/or modified sequence opt4 from anti-HIV_Chain
cagggccagcuggugcagagcggcggcggcggcaagaagcugggcaccagcgugaccaucagcugccuggccagcgaguacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugagcagcgccagcaccaagggc

SEQ ID NO: 34967 - RNA, 387 nt, Artificial Sequence
  derived and/or modified sequence opt4 from anti-HIV_Chain
gaggugcagcugguggagagcggcgccgaggugaagaagcccggcgccagcgugaaggugagcugcaaggugagcggcuacacccugagcgaccugagcaugcacugggugagacaggcccccggcaagggccuggaguggaugggcggcuucgacgaggaggacggcgagaucaccuacgcccagaaguuccagggcagagugagcaugaccgaggacaccagcagagacaccgccuacauggagcugagcagccugagaagcgaggacaccgccguguacuacugcgccaccgcccccagacuggagcugggcgagcugagcagcggcuuccacuacuggggccugggcacccuggugaccgugagcagcgccagcaccaagggc

SEQ ID NO: 34968 - RNA, 387 nt, Artificial Sequence
  derived and/or modified sequence opt4 from anti-HIV_Chain
cagggccagcuggugcagagcggcggcggcgugaagaagaccggcaccagcgugaccaucagcugccuggccagcgaguacaccuucaccgaguucaccauccacuggaucagacaggcccccggccagggcccccuguggcugggccugaucaagagaagcggcagacugaugaccgccaacagauuccaggacagacugagccugagaagagacagaagcaccggcaccguguucauggagcugagaagccugagaaucgacgacaccgccguguacuacugcgccagagacggccugggcgagcuggcccccgccuaccacuacggcaucgacguguggggccagggcaccaccaucaucgugaccagcgccagcaccaagggc

SEQ ID NO: 34969 - RNA, 387 nt, Artificial Sequence
  derived and/or modified sequence opt4 from anti-HIV_Chain
cagggccagcuggugcagagcggcggcggcgugaagaagcugggcaccagcgugaccaucagcugccuggccagcgaguacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugaccagcgccagcaccaagggc

SEQ ID NO: 34970 - RNA, 387 nt, Artificial Sequence
  derived and/or modified sequence opt4 from anti-HIV_Chain
cagggccagcuggugcagagcggcggcggcgugaagaagcugggcaccagcgugaccauccccugccuggccagcgaguacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugaccagcgccagcaccaagggc

SEQ ID NO: 34971 - RNA, 387 nt, Artificial Sequence
  derived and/or modified sequence opt4 from anti-HIV_Chain
cagggccagcuggugcagagcggcggcggcgugaagaagcccggcaccagcgugaccaucagcugccuggccagcgaguacaccuucaacgaguucgugauccacuggaucagacaggcccccggccagggccccguguggcugggccugaucaagagaagcggcagacugaugaccagcuacaaguuccaggacagacugagccugagaagagacagaagcaccggcaccguguucauggagcugagaggccugagacuggacgacaccgccguguacuacugcgccagagacggccugggcgagguggcccccgccuaccuguacggcaucgacgccuggggccagggcagcaaggugaucgugacccccgccagcaccaagggc

SEQ ID NO: 34972 - RNA, 387 nt, Artificial Sequence
  derived and/or modified sequence opt4 from anti-HIV_Chain
caggccagacuggaccaguggggcaccggccugcugaagcccagcgagacccugagccugaagugcgccguguucggcgugcuguucaccgacuacaacuggaccugggugagacagagccccggcaaggagcuggaguggaucggccaccuggaccacagaggcggcggcaacuacaaccccagccuggagagcagagugaccaucagccuggacuacagcaaggcccaguucagccugcaccugaagagcgugaccguggccgacaccgccagauacuacugcgccggcgccgugaagggcuucugguucgacgaccccuacaccugguucggccccuggagccagggcacccuggugaccguggccagcgccagcaccaagggc

SEQ ID NO: 34973 - RNA, 387 nt, Artificial Sequence
  derived and/or modified sequence opt4 from anti-HIV_Chain
caggccagacuggaccaguggggcaccggccugcugaagcccagcgagacccugagccugaagugcgccguguucggcgugcuguucaccgacuacaacuggaccugggugagacagagccccggcaagggccuggaguggaucggccaccuggaccacagaggcggcggcagcuacaaccccagccuggagagcagagugagcaucagccuggacuacagcaaggcccaguucagccugcaccugaagagcgugaccguggccgacaccgcccuguacuacugcgccggcgccgugaagggcuucugguucgacgagcccagcaccugguucggccccuggagccagggcaccauggugaccguggccagcgccagcaccaagggc

SEQ ID NO: 34974 - RNA, 387 nt, Artificial Sequence
  derived and/or modified sequence opt4 from anti-HIV_Chain
cagggccaccuggugcagagcggcggcggcgugaagaagcugggcaccagcgugaccaucagcugccuggccagcgaggacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugaccagcgccagcaccaagggc

SEQ ID NO: 34975 - RNA, 387 nt, Artificial Sequence
  derived and/or modified sequence opt4 from anti-HIV_Chain
caggugcagcuggugcagagcgaggccgaggugaagaagcccggcagcagcgugaaggugagcugcaaggccagcggcggcaccuucagaggcuacaccaucagcugggugagacaggcccccggccagggccuggaguggaugggcagaaucauccccauccugggcaaggccaucuacgcccccagcuuccagggcagagugacccugaccgccgacaagagcaccggcaccgccuacauggagcugagcagacugagaagcgacgacaccgccguguacuacugcgccaaggugaagaugagaggcagcagcggcuacuacuaccuguucgacgacuggggccagggcacccuggugaccgugagcagcgccagcaccaagggc

SEQ ID NO: 34976 - RNA, 387 nt, Artificial Sequence
  derived and/or modified sequence opt4 from anti-HIV_Chain
caggccagacuggaccaguggggcaccggccugcugaagcccagcgagacccugagccugaagugcgccguguucggcgugcuguucaccgacuacaacuggaccugggugagacagagccccggcaagggccuggaguggaucggccaccuggaccacagaggcggcggcaacuacaaccccagccuggagagcagagugaccaucagccuggacuacagcaaggcccaguucagccugcaccugaagagcgugaccguggccgacaccgcccuguacuacugcgccggcgccgugaagggcuucugguucgacgagguguacaacugguucggccccuggagccagggcacccuggugaccguggccagcgccagcaccaagggc

SEQ ID NO: 34977 - RNA, 387 nt, Artificial Sequence
  derived and/or modified sequence opt4 from anti-HIV_Chain
cagggccagcuggugcagagcggcggcggcgugaagaagcccggcaccagcgugaccaucagcugccuggccagcgaguacaccuucaccgaguucaccauccacuggaucagacaggcccccggccagggcccccuguggcugggccugaucaagagaagcggcagacugaugaccgccuacagauuccaggacagacugagccugagaagagacagaagcaccggcaccguguucauggagcugagaaaccugagaauggacgacaccgccguguacuacugcgccagagacggccugggcgagcuggcccccgccuaccaguacggcaucgacguguggggccagggcaccaccgugaucgugagcagcgccagcaccaagggc

SEQ ID NO: 34978 - RNA, 387 nt, Artificial Sequence
  derived and/or modified sequence opt4 from anti-HIV_Chain
caggugagacuggugcagagcggcccccaggugaagagacccggcgccagcaucagacugagcugcgagagcagcggcuacagauuccaggacuacaucguggccuggaucagacagaccagaggccagggcuucgaguucgugggcauggugaaccccagaggcggcagacccuggcccagcagcagauucagagacagagugacccugaccagagacaucgagagcgagaccuucuaccugggccugaacgaccugaccagcgacgacaccgccaccuacuucugcgccagacuggaggccgacggcagcgacuacagccccaagauguucgacuucuggggccagggcaccaagaucguggugagccccgccagcaccaagggc

SEQ ID NO: 34979 - RNA, 387 nt, Artificial Sequence
  derived and/or modified sequence opt4 from anti-HIV_Chain
caggugagacuggugcagagcggcccccaggugaagacccccggcgccagcaugagagugagcugcgaggccagcggcuacagauuccuggacuacaucaucguguggaucagacagacccacggccagcacuucgaguacgugggcaugaucaaccccagaggcggcacccccuggcccagcagcaaguucagagacagacugagccugaccagagacauccacaccgacaccuucuaccugggccugaacaaccugggcagcgacgacaccgccaucuacuucugcgccagacuggaggccgacggcgacgacuacagccccaagauguucgaccacuggggccagggcaccagaaucaucgugagcgccgccagcaccaagggc

SEQ ID NO: 34980 - RNA, 387 nt, Artificial Sequence
  derived and/or modified sequence opt4 from anti-HIV_Chain
caggugagacuggugcagagcggcccccaggugaagacccccggcgccagcaucagacugagcugcgaggccagcggcuacagauuccuggacuacuucaucgugugggugagacagacccccggccagggcuucgaguacgugggcaugaucaaccccagaggcggcagacccuggagcagcuggaaguucagagacagacugagccugaccagagagaucgacaccgacaccuucuaccugggccugagcaaccugagaagcgacgacaccgccaucuacuucugcgccagacuggaggccgacggcgacgacuacagccccaagaugguggacuacuggggccagggcaccaagaucaucgugagcgccgccagcaccaagggc

SEQ ID NO: 34981 - RNA, 387 nt, Artificial Sequence
  derived and/or modified sequence opt4 from anti-HIV_Chain
caggugagacuggugcagagcggcccccaggugaagagacccggcgccagcaucagacugagcugcgagaccagcggcuacagauuccaggacuacaucguggccuggaucagacagaccagaggccagagauucgaguucgugggcauggugaaccccagaggcggcagacccuggcccagcagcaaguucagagacagagugacccugaccagagacaucgagagcgagaccuuccaccugggccugaacgaccugaccagcgacgacaccgccaccuacuucugcgccagacuggaggccgacggcgccgacuacagccccaagauguucgacuucuggggccagggcaccaagaucguggugagccccgccagcaccaagggc

SEQ ID NO: 34982 - RNA, 387 nt, Artificial Sequence
  derived and/or modified sequence opt4 from anti-HIV_Chain
caggugagacuggugcagagcggcccccaggugaagacccccggcgccagcaugagaaucagcugcgaggccagcggcuacagauuccaggacuacaucaucguguggaucagacagacccacggccagggcuucgaguacgugggcaugaucaaccccagaggcggcacccccuggagcagcagcaaguucagagacagacugagccugaccagagacaucuacaccgacaccuucuaccugggccugaacaaccugggcagcgacgacaccgccaucuacuucugcgccagacuggaggccgacggcggcgacuacagccccaagauguucgacuacuggggccagggcaccagaaucaucgugagcgccgccagcaccaagggc

SEQ ID NO: 34983 - RNA, 387 nt, Artificial Sequence
  derived and/or modified sequence opt4 from anti-HIV_Chain
cagggccagcuggugcagagcggcggcggcgugaagaagcccggcgccagcgugaccaucagcugccuggccagcgaguacaccuucaacgaguucgugauccacuggaucagacaggcccccggccagggcccccuguggcugggccugaucaagagaagcggcagacugaugaccgccuacaaguuccaggacagacugagccugagaagagacagaagcaccggcaccguguucauggagcugagaggccugagacccgaggacaccgccguguacuacugcgccagagacggccugggcgagguggcccccgacuacagauacggcaucgacguguggggccagggcagcaccgugaucgugagcgccgccagcaccaagggc

SEQ ID NO: 34984 - RNA, 387 nt, Artificial Sequence
  derived and/or modified sequence opt4 from anti-HIV_Chain
caggugagacuggugcagagcggcccccagaugaagacccccggcgccagccugagacugagcugcgaggugagcggcuacagauuccuggacuacuucaucgugugggugagacagaccggcggccagggcuucgaguacgugggcaugaucaaccccagaggcggcagacccuggagcagcuggaaguucagagacagacugagccugaccagagacaucgagaccgacaccuucuaccugggccugaacaaccugagaagcgacgacaccgccaucuacuucugcgccagacuggaggccgacggcgacaacuacagccccaagaugguggacuacuggggccagggcaccaagaucaucgugagccccgccagcaccaagggc

SEQ ID NO: 34985 - RNA, 387 nt, Artificial Sequence
  derived and/or modified sequence opt4 from anti-HIV_Chain
caggugagccuggugcagagcggcccccaggugaagacccccggcgccagcaugagagugagcugcgagaccagcggcuacagauuccuggacuacaucaucguguggaucagacagacccacggccagcacuucgaguacgugggcaugaucaaccccagaggcggcacccccuggcccagcagcaaguucagagacagacugaccaugaccagagacauccacaccgacaccuucuaccugggccugaacaaccugagaagcgacgacaccgccaucuacuucugcgccagacuggaggccgacggcgacgacuacagccccaagauguucgacuacuggggccagggcaccagaaucaucgugagcgccgccagcaccaagggc

SEQ ID NO: 34986 - RNA, 387 nt, Artificial Sequence
  derived and/or modified sequence opt4 from anti-HIV_Chain
caggugagacuggugcagagcggcccccaggugaagaccgccggcgccagcaugagagugagcugcgaggccagcggcuacagauuccuggacuacaucaucguguggaucagacagacccacggccagcacuucgaguacgugggcaugaucaaccccagaggcggcacccccuggcccagcagcaaguucagagacagacugacccugaccagagacaucuacaccgacaccuucuaccugggccugaacaaccugggcagcggcgacaccgccaucuacuucugcgccagacuggaggccgacggcgacgacuacagccccaagauguucgacuacuggggccagggcaccagaaucaucgugagcgccgccagcaccaagggc

SEQ ID NO: 34987 - RNA, 387 nt, Artificial Sequence
  derived and/or modified sequence opt4 from anti-HIV_Chain
cagggccagcuggugcagagcggcggcggcgugaagaagcccggcaccagcgugaccaucagcugccuggccagcgaguacaccuucaacgaguucgugauccacuggaucagacaggcccccggccagggccccguguggcugggccugaucaagagaagcggcagacugaugaccagcuacaaguuccaggacagacugagccugagaagagacagaagcaccggcaccguguucauggagcugagaggccugagacuggacgacaccgccguguacuacugcgccagagacggccugggcgagguggcccccgccuaccuguacggcaucgacgccuggggccagggcagcaccgugaucgugaccagcgccagcaccaagggc

SEQ ID NO: 34988 - RNA, 387 nt, Artificial Sequence
  derived and/or modified sequence opt4 from anti-HIV_Chain
cagggccagcuggugcagagcggcggcggccugaagaagcccggcaccagcgugaccaucagcugccuggccagcgaguacaccuucaacgaguucgugauccacuggaucagacaggcccccggccagggcccccuguggcugggccugaucaagagaagcggcagacugaugaccgccuacaacuuccaggacagacugagacugagaagagacagaagcaccggcaccguguucauggagcugagaggccugagacccgacgacaccgccguguacuacugcgccagagacggccugggcgagguggcccccgacuacagauacggcaucgacguguggggccagggcagcaccgugaucgugaccgccgccagcaccaagggc

SEQ ID NO: 34989 - RNA, 387 nt, Artificial Sequence
  derived and/or modified sequence opt4 from anti-HIV_Chain
cagggccaccuggugcagagcggcggcggcgugaagaagcugggcaccagcgugaccaucagcugccuggugagcgaguacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugaccagcgccagcaccaagggc

SEQ ID NO: 34990 - RNA, 387 nt, Artificial Sequence
  derived and/or modified sequence opt4 from anti-HIV_Chain
cagggccagcuggugcagagcggcggcggcgugaagaagcugggcaccagcgugaccaucagcugccuggccagcgaguacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugagcagcgccagcaccaagggc

SEQ ID NO: 34991 - RNA, 387 nt, Artificial Sequence
  derived and/or modified sequence opt4 from anti-HIV_Chain
cagggccaccuggugcagagcggcggcggcgugaagaagcugggcaccagcgugaccaucagcugccuggccagcgaguacaccuucaacgaguucgugauccacuggaucagacaggcccccggccagggcccccuguggcugggccugaucaagagaagcggcagacugaugaccagcuaccaguuccaggacagacugagccugagaagagacagaagcaccggcaccguguucauggagcugagaggccugagaguggacgacaccgccguguacuacugcgccagagacggccugggcgagguggcccccgccuaccuguacggcaucgacgccuggggccagggcaccaccgugaucgugaccagcgccagcaccaagggc

SEQ ID NO: 34992 - RNA, 387 nt, Artificial Sequence
  derived and/or modified sequence opt4 from anti-HIV_Chain
caggugcagcuggugcagagcggcagcgagcugaagaagcccggcgccagcgugaaggugagcugcaaggccagcggcuacaccuucaccagcuacgccaucaacugggugagacaggcccccggccagggccuggaguggaugggcuggaucaacaccaacaccggcaaccccaccuacgcccagggcuucaccggcagauucguguucagccuggagaccagcgugagcaccgccuaccugcagaucaacagccugaaggccgaggacaccgccguguacuacugcgccagagaccugcuggagagcagaaccuacuacaacgacaucagagacugcuggggccagggcacccuggugaccgugagcagcgccagcaccaagggc

SEQ ID NO: 34993 - RNA, 387 nt, Artificial Sequence
  derived and/or modified sequence opt4 from anti-HIV_Chain
caggugcagcuggugcagagcggcgccgaggugaagaagcccggcgccagcgugaaggugagcugcaaggccagcggcuacaccuucaccgacuacuacauccacugggugagacaggcccccggccagggccuggaguggaugggcuggaucaaccccagcaccggcggcaccaacuucgugcagaaguuccugggcagagugaccaugaccagcgacaccagcaucaacaccgccuacauggagcugagaagacugaagaacgacgacgccgccaucuacuacugcgccaccuacagcaccagacaguucuuccacuacuacuacgugaccgacguguggggccagggcaccaccgugaccgugagcagcgccagcaccaagggc

SEQ ID NO: 34994 - RNA, 387 nt, Artificial Sequence
  derived and/or modified sequence opt4 from anti-HIV_Chain
uuccagggccagcuggugcagagcggcggcggcgugaagaagcccggcagcagcgugaccaucagcugccuggccagcgaguacaccuucaccgaguucaccauccacuggaucagacaggcccccggccagggcccccuguggcugggccugaucaagagaagcggcagacugaugaccagcuacggcuuccaggacagacugagcgugagaagagacagaagcaccggcaccguguucauggagcugagaagccugagaaccgacgacaccgccguguacuacugcgccagagacggccugggcgagcuggcccccgccuaccacuacggcaucgacguguggggccagggcaccaccgugaucgugaccagcgccagcaccagc

SEQ ID NO: 34995 - RNA, 387 nt, Artificial Sequence
  derived and/or modified sequence opt4 from anti-HIV_Chain
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgugaucagcuacgacggcagcaacaaguacuacgccgacagcgugaagggcagauucaccaucagcagagacgacagcaagagcaccguguaccugcagaucaacagccugagagccgccgacaccgccguguacuucugcgccagagagggcggccugagauuccuggaguggcuguucuggggccagggcacccuggugaccgugagcagcggcgagagcagcgccagcaccaagggc

SEQ ID NO: 34996 - RNA, 390 nt, Artificial Sequence
  derived and/or modified sequence opt4 from anti-HIV_Chain
caggugcagcuggugcagagcggcgccguggugaagagccccggcagcagcgccaagcugagcugcagacugcugggcgacgaguucggcaccuacuucaucagcuggaucagacaggcccccggcagaggccuggagugggugggcggcaucgugccccacagccagcugcagagcagcgcccagaaguuccacggcagauucuucaucaccggcggcgugaccccccccaucaucuuccugcagcugaccaacgugaccuucgaggacaccggcaccuacuucugcgccagagagagaggcagacacagagaccccaagaccggcaagagccugagaggcagauacuucgacuucuggggcagaggcaccggcgugaccgugagcccc

SEQ ID NO: 34997 - RNA, 390 nt, Artificial Sequence
  derived and/or modified sequence opt4 from anti-HIV_Chain
cagaucgagcugagacagagcggcgccgccaugaagagccccggcagcagcgugaagcugagcugcaccgugcugggcgagaacuucggcaccuacuucaucagcuggaucagacaggcccccggccagggccuggagugggugggcggcaucgugccccacagccagcugcagagcagcgcccagaaguuccacggcagaaucaagaucagcggcggcggcaccccccccguggugagccuggagcugaccaacgugaccuucgacgacaccggcaccuacuucugcgccagagagagaggcagacacguggagcccaagaccggcgacagacuggccggcagauacuucgacaucuggggcagaggcaccggccugagagugagcccc

SEQ ID NO: 34998 - RNA, 390 nt, Artificial Sequence
  derived and/or modified sequence opt4 from anti-HIV_Chain
gaggugcagcugguggagagcggcggcggccuggugaagcccggcggcagccugagacugagcugcgaggccagcggcuucaccuucaccaacgccuggaugaacugggugagacaggcccccggcaagggccuggagugggugggcagaaucaagagccagacccacggcggcaccaccagauacgccgcccccgugaagggcagauucaccaucagcagagacgacagcaagcacacccuguaccugcagauggacagacugaccaccgaggacaccgccguguacuacugcaccggcaccaucaccggcagcaccuucuacuacuacggcauggacguguggggccagggcaccaccgugaccgugagccccgccagcaccaagggc

SEQ ID NO: 34999 - RNA, 390 nt, Artificial Sequence
  derived and/or modified sequence opt4 from anti-HIV_Chain
guggugcagcuggugcagagcggccccggccuggugaagcccagccagacccugagccugaccugcaccgugagcggcggcagcaucagcagcggcgacuucuacuggagcuggaucagacagccccccggcaagggccuggaguggaucggcuacaucuacuacagcggcagcaccuacuacaaccccagccugaagagcagacugaccaucagcguggacaccagcaagaaccaguucagccugagacugagcagcgugaccgccgccgacaccgccguguacuacugcgccagagaccugaacagcagaaucgugggcgcccuggacgccuucgacaucuggggccagggcaccauggugaccgugagcagcgccagcaccaagggc

SEQ ID NO: 35000 - RNA, 390 nt, Artificial Sequence
  derived and/or modified sequence opt4 from anti-HIV_Chain
gaggugcagcuggugcagagcggcggcggccuggugcagcccggcagaagccugagacugagcugcgccgccagcggcuucaccuucgacgacuacgccaugcacugggugagacaggcccccggcaagggccuggagugggugagcggcaucagcuggaacagcggcaccaucggcuacgccgacagcgugagaggcagauucaccaucagcagagacgacgccaagagcagccuguaccugcagaugaacagccugagaaccgaggacaccgcccuguacuacugcgccaaggacggcugggugggcagcggcagcagcacccugagaggcagcgacuacuggggccagggcacccuggugaccgugagcagcgccagcaccaagggc

SEQ ID NO: 35001 - RNA, 390 nt, Artificial Sequence
  derived and/or modified sequence opt4 from anti-HIV_Chain
cagagcgugcugacccagccccccagcgccagcggcagccccggccagagcaucaccaucagcugcaccggcaccagcagcgacgugggcggcuacaacuacgugagcugguaccagcagccccccggcaaggcccccaaggugaucaucuacgaggugagcaagagacccagcggcgugcccgacagauucagcggcagcaagagcggcaacaccgccagccugaccgugagcggccugcaggccgaggacgaggccgacuacuacugcagcagcuacgccggcagcaacaacuucguguucggcaccggcaccgaggugaccguggugggccagcccaaggccaaccccaccgugacccuguucccccccagcagcgaggagcugcug

SEQ ID NO: 35002 - RNA, 390 nt, Artificial Sequence
  derived and/or modified sequence opt4 from anti-HIV_Chain
caggccguggugacccaggagcccagccugaccgugagccccggcggcaccgugacccugaccugcgccagcagcaccggcgccgugaccagcggcuucuacccccacugguuccagcagaagcccggccaggcccccagagcccugaucuacagcaccagcaacagauacagcuggacccccgccagauucagcggcagccugcugggcggcaaggccgcccugacccugagcggcgugcagcccgaggacgaggccgaguacuacugccugcugcugcccuacuacggcggccccuggaucuucggcggcggcaccaagcugaccgugcugggccagcccaaggccgcccccagcgugacccuguucccccccagcagcgaggagcug

SEQ ID NO: 35003 - RNA, 390 nt, Artificial Sequence
  derived and/or modified sequence opt4 from anti-HIV_Chain
cagagcgcccugacccagccccccagcgccagcggcgcccccggccagagagugaccaucagcugcagcggcggccccagcaacgugggcggcaacuacguguacugguacagacaguuccccggcaccgcccccacccugcugauccugagagacgaccagagacccagcggcgugcccgacagauucagcgccagcaagagcggcaacagcgccagccuggccaucagcggccugagacccgacgacgagggcuucuacuucugcgccaccuacgacagcgacggcagcaucagacuguucggcggcggcaccgcccugaccgugcugagccagcccaaggccgcccccagcgugacccuguucccccccagcagcgaggagcugaag

SEQ ID NO: 35004 - RNA, 390 nt, Artificial Sequence
  derived and/or modified sequence opt4 from anti-HIV_Chain
caggugcagcugguggagagcggcagcgacgugagaaagcccggcgccaccgugaccgugagcugcaaggccgacgaggacgaggacgacuucaccgccuacaacuacuucaugcacugggugagacaggcccccggccacggccuggaguggaucggcuggaucaaccccagaaccggccagcccaaccacgccaagcaguuccagggcagagugacccugaccagagagagaagcaccagcaccguguucaugaagcugaccaaccugagacuggacgacaccgccguguacuucugcgccagaccccugagaggcggcgacaccuggcacuaccacagcuggggcagaggcaccagccugaccgugagcagcgccagcaccaagggc

SEQ ID NO: 35005 - RNA, 390 nt, Artificial Sequence
  derived and/or modified sequence opt4 from anti-HIV_Chain
gaggugcagcugguggagagcggcagcgacgugagaaagcccggcgccaccgugaccgugagcugcaaggccgacgaggacgaggacgacuucaccgccuacaacuacuucaugcacugggugagacaggcccccggccacggccuggaguggaucggcuggaucaaccccagaaccggccagcccaaccacgccaagcaguuccagggcagagugacccugaccagagagagaagcaccagcaccguguucaugaagcugaccaaccugagacuggacgacaccgccguguacuucugcgccagaccccugagaggcggcgacaccuggcacuaccacagcuggggcagaggcaccagccugaccgugagcagcgccagcaccaagggc

SEQ ID NO: 35006 - RNA, 390 nt, Artificial Sequence
  derived and/or modified sequence opt4 from anti-HIV_Chain
gaggugcagcuggugcagagcggcagcgacgugagaaagcccggcgccaccgugaccgugagcugcaaggccgacgaggacgaggacgacuucaccgccuacgacuacuucaugcacugggugagacaggcccccggccacggccuggaguggaucggcuggaucaaccccagaaccggccagcccaaccacgccaagcaguuccagggcagagugacccugaccagagagagaagcaccagcaccguguucaugaagcugaccaaccugagacuggacgacaccgccguguacuucugcgccagaccccugagaggcggcgacaccuggcacuaccacagcuggggcagaggcaccagccugaccgugagcagcgccagcaccaagggc

SEQ ID NO: 35007 - RNA, 390 nt, Artificial Sequence
  derived and/or modified sequence opt4 from anti-HIV_Chain
caggugcagcuggugcagagcggcagcgacgugagaaagcccggcgccaccgugaccgugagcugcaaggccgacgaggacgaggacgacuucaccgccuacaacuacuucaugcacugggugagacaggcccccggccacggccuggaguggaucggcuggaucaaccccagaaccggccagcccaaccacgccaagcaguuccagggcagagugacccugaccagagagagaagcaccagcaccguguucaugaagcugaccaaccugagacuggacgacaccgccguguacuucugcgccagaccccugagaggcggcgacaccuggcacuaccacagcuggggcagaggcaccagccugaccgugagcagcgccagcaccaagggc

SEQ ID NO: 35008 - RNA, 390 nt, Artificial Sequence
  derived and/or modified sequence opt4 from anti-HIV_Chain
caggugcagcuggugcagagcggcagcgacgugagaaagcccggcgccaccgugaccgugagcugcaaggccgacgaggacgaggacgacuucaccgccuacaacuacuucaugcacugggugagacaggcccccggccacggccuggaguggaucggcuggaucaaccccagaaccggccagcccaaccacgccaagcaguuccagggcagagugacccugaccagagagagaagcaccagcaccguguucaugaagcugaccaaccugagacuggacgacaccgccguguacuucugcgccagaccccugagaggcggcgacaccuggcacuaccacagcagaggcagaggcaccagccugaccgugagcagcgccagcaccaagggc

SEQ ID NO: 35009 - RNA, 390 nt, Artificial Sequence
  derived and/or modified sequence opt4 from anti-HIV_Chain
gaggugcagcugguggagagcggcagcgacgugagaaagcccggcgccaccgugaccgugagcugcaaggccgacgaggacgaggacgacuucaccgccuacaacuacuucaugcacugggugagacaggcccccggccagggccuggaguggaucggcuggaucaaccccagaaccggccagcccaaccacgccaagcaguuccagggcagagugacccugaccagagagagaagcaccagcaccguguucaugaagcugaccaaccugagacuggacgacaccgccguguacuucugcgccagaccccugagaggcggcgacaccuggcacuaccacagcuggggcagaggcaccagccugaccgugagcagcgccagcaccaagggc

SEQ ID NO: 35010 - RNA, 390 nt, Artificial Sequence
  derived and/or modified sequence opt4 from anti-HIV_Chain
guggugcagcuggugcagagcggcagcgacgugagaaagcccggcgccaccgugaccgugagcugcaaggccgacgaggacgaggacgacuucaccgccuacaacuacuucaugcacugggugagacaggcccccggccacggccuggaguggaucggcuggaucaaccccagaaccggccagcccaaccacgccaagcaguuccagggcagagugacccugaccagagagagaagcaccagcaccguguucaugaagcugaccaaccugagacuggacgacaccgccguguacuucugcgccagaccccugagaggcggcgacaccuggcacuaccacagcuggggcagaggcaccagccugaccgugagcagcgccagcaccaagggc

SEQ ID NO: 35011 - RNA, 390 nt, Artificial Sequence
  derived and/or modified sequence opt4 from anti-HIV_Chain
gaggugcagcuggugcagagcggcagcgacgugagaaagcccggcgccaccgugaccgugagcugcaaggccgacgaggacgaggacgacuucaccgccuacaacuacuucaugcacugggugagacaggcccccggccacggccuggaguggaucggcuggaucaaccccagaaccggccagcccaaccacgccaagcaguuccagggcagagugacccugaccagagagagaagcaccagcaccguguucaugaagcugaccaaccugagacuggacgacaccgccguguacuucugcgccagaccccugagaggcggcgacaccuggcacuaccacagcuggggcagaggcaccagccugaccgugagcagcgccagcaccaagggc

SEQ ID NO: 35012 - RNA, 390 nt, Artificial Sequence
  derived and/or modified sequence opt4 from anti-HIV_Chain
gaggugcagcuggugcagagcggcagcgacgugaagaagcccggcaccaccgugaccaucagcugcaaggccgacgaggacgaggacgacuucaccgccuacaacuacuucaugcacugggugagacaggcccccggccagggccuggaguggaucggcuggaucaaccccagaaccggccagcccaaccacgccaagcagcugcagggcagagugacccugaccagagagagaagcaccagcaccguguucaugaagcugaccaaccugagacuggacgacaccgccguguacuucugcgccagaccccugagaggcggcgacaccuggcacuaccacagcuggggcagaggcaccagccugaucgugagcagcgccagcaccaagggc

SEQ ID NO: 35013 - RNA, 390 nt, Artificial Sequence
  derived and/or modified sequence opt4 from anti-HIV_Chain
caggugcagcugguggagagcggcggcggccuggugaagcccggcggcagccugagacugagcugcgccgccagcggcuucagcuucaacgaguacuacaugagcuggaucagacaggcccccggccagggccuggaguggguggccaacaucggcagcagcgacgccuacaccaucuacgccgacagcgugaagggcagauucaccaucagcagagacaacgccgagaacaccguguaccugcagaugaacagccugagaggcgaggacaccgccguguacuacugcgccagaaucgagggcuacugcagcaacagcagaugcagcaacuacuucgaccccuggggccagggcgcccuggugaccgugagcagcgccagcaccaagggc

SEQ ID NO: 35014 - RNA, 390 nt, Artificial Sequence
  derived and/or modified sequence opt4 from anti-HIV_Chain
caggugcagcuggugcagagcggcgccgaggugaagaagcccggcgccagcgugaaggugagcugcaaggugagcggcuacccccuggccgagcugagcgugcacugggugagacaggugcccggcaagggccuggagugggugggcggcuucgaccccgaggagggcaagaccguguacgcccagaaguuccagggcagagugaccaugaccgaggacagaagcaccgacaccguguacauggagcugaucagccugagauacgaggacaccgccguguacuacugcgccaccgacaaccccgugcugcagcugggcgagcugagcagcagccuggacuacuggggccagggcacccuggugaccgugagcagcgccagcaccaagggc

SEQ ID NO: 35015 - RNA, 390 nt, Artificial Sequence
  derived and/or modified sequence opt4 from anti-HIV_Chain
gaggugcagcuggugcagagcggcgccgaggugaagaagcccggcgagagccugagaaucagcugcaagaccagcggcuacaacuucaacgacgacuggaucgccugggugagacagagacccgacaagggccccgaguggaugggcaucuucuaccccggcgacagccaggccaccuacagccccagcuuccagggccacgugaccuucagcgccgacaccagcaucagcaccgccuaccugcaguggaccagccugaaggccagcgacaccgccaucuacuacugcgccagaaccagaugcuucggcgccaacugcuucaacuucauggacguguggggcaagggcaccgcccugaccgugaccgugagcagcgccagcaccaagggc

SEQ ID NO: 35016 - RNA, 390 nt, Artificial Sequence
  derived and/or modified sequence opt4 from anti-HIV_Chain
caggugcagcuggugcagcugcugcagagcggcgccgaggugaagaagcccggcagcagcgugaaggugagcugccagaucagcggcuacggcuucagcaacuacgccaucagcugggugagacaggcccccggccagggccuggaguggcugggcagaaucgugcccgccgugggcaugaccgaguacgcccagaaguuccagggcagagugaccuucaccgccgacagaagcaccaucaccgccuacauggaccugagaggccugagaagcgacgacaccgccguguacuacugcgugagagacccccagguggaggugagaggcaacgccuucgacaucuggggccagggcaccauggugaccgugagcagcgccagcaccaagggc

SEQ ID NO: 35017 - RNA, 390 nt, Artificial Sequence
  derived and/or modified sequence opt4 from anti-HIV_Chain
caggugcaccugcagcaguggggcgccggccugcugaagcccagcgagacccugagccugaccugcgccgugagcggcggcagcuucagcggcuucuucuggaccuggaucagacagagccccggcaagggccuggaguggaucggcgaggugaaccacagcggcuucacccacagcaaccccagccuggagagcagagccaccaucagcguggccgccagcaacacccaguucagccugagacuggccagcgugaccgccgccgacaccgccaucuacuucugcgcccugagauacuucgacuggagccccuucagaagagacaccuacggcaccgacguguggggccagggcaccaccgugaucgugagcagcgccagcaccaagggc

SEQ ID NO: 35018 - RNA, 390 nt, Artificial Sequence
  derived and/or modified sequence opt4 from anti-HIV_Chain
caggugagacuggagcagagcggcggcgcccugagaaagcccggcgccagcgugacccugagcugccaggccagcggcuacaacuucgugaaguacaucauccacugggugagacagagacccggccugggcuucgagugggugggcaugaucgaccccuacagaggcagacccugguacgcccacagcuucgccggcagacugagccugagcagagacaccagcaccgagacccuguacaugacccugagcagccugaagagcgacgacaccgccaccuacuucugcgccagagccgaggccgccagcgacagccacagcagacccaucauggacuggaccuggagaauccugugccugcuggccguggugcccgccagcaccaagggc

SEQ ID NO: 35019 - RNA, 390 nt, Artificial Sequence
  derived and/or modified sequence opt4 from anti-HIV_Chain
caggugagacuggagcagagcggcgccgccgugagaaagcccggcgccagcgugacccugagcugccaggccagcggcuacaacuucgugaacuacaucauccacugggugagacagagacccggccuggacuucgagugggugggcaugaucgaccccuacagaggcagacccuggagcgcccacaaguuccagggcagacugagccugagcagagacgugagcaccgagauccuguacaugacccugaacagccugagaagcgacgacaccgccaccuacuucugcgccagagccgaggccgagagccagagccacagcagacccaucauguucgacagcuggggccagggcagcagagugaccgugagcagcgccagcaccaagggc

SEQ ID NO: 35020 - RNA, 390 nt, Artificial Sequence
  derived and/or modified sequence opt4 from anti-HIV_Chain
caggugagacuggagcagagcggcgccgccgugaagaagcccggcgccagcgugaccaucagcugccaggccagcggcuacaacuucgugaaguucuucauccacugggugagacagagacccggccagggcuucgagugggugggcaugaucgagcccuacagaggcagacccuggagcgccggcaacuuccagggcagacugagccugagcagagacgugagcaccgagacccuguacaugacccugaacaaccugagaagcgacgacaccgccguguacuucugcgccagacuggaggccgagagcgacagccacagcagacccaucauguucgaccacuggggccacggcagccuggugaccgugagcagcgccagcaccaagggc

SEQ ID NO: 35021 - RNA, 390 nt, Artificial Sequence
  derived and/or modified sequence opt4 from anti-HIV_Chain
caggugagacuggagcagagcggcgccgccgugagaaagcccggcgccagcgugacccugagcugccaggccagcggcuacaacuucgugaacuacaucauccacugggugagacagagacccggccuggacuucgagugggugggcaugaucgaccccuacagaggcagacccuggagcgcccacaaguucgagggcagacugagccugagcagagacgugagcaccgaggugcuguacaugacccugagcagccugagaagcgacgacaccgccaccuacuucugcgccagagccgaggccgagagccagagccacagcagacccaucauguucgacuacuggggccagggcagcagagugaccgugagcagcgccagcaccaagggc

SEQ ID NO: 35022 - RNA, 390 nt, Artificial Sequence
  derived and/or modified sequence opt4 from anti-HIV_Chain
caggugagacuggagcagagcggcaccgccgugagaaagcccggcgccagcgugaccaucagcugccaggccagcggcuacaacuucgugaaguucuucauccacggcgugagacagagacccggccagggcuucgagugggugggcaugaucgagcccuucagaggcagacccuggagcgccggcaacuuccagggcagacugagccugagcagagacgugagcaccgagacccuguacaugacccugaacaaccugagaagcgacgacaccgccguguacuucugcgccagacuggaggccgagagcgacagccacagcagacccaucauguucgaccacuggggccacggcagccuggugaccgugagcagcgccagcaccaagggc

SEQ ID NO: 35023 - RNA, 390 nt, Artificial Sequence
  derived and/or modified sequence opt4 from anti-HIV_Chain
caggugagacuggagcagagcggcaccgccaugagaaagcccggcgccagcgugacccugagcugccaggccagcggcuacaacuucgugaaguacaucgugcacugggugagacagaagcccggccugggcuucgagugggugggcaugaucgaccccuacagaggcagacccuggagcgcccacaaguuccagggcagacugagccugagcagagacaccagcauggagauccuguacaugacccugaccagccugaagagcgacgacaccgccaccuacuucugcgccagagccgaggccgccagcgacagccacagcagacccaucauguucgaccacuggggccagggcagcagagugaccgugagcagcgccagcaccaagggc

SEQ ID NO: 35024 - RNA, 390 nt, Artificial Sequence
  derived and/or modified sequence opt4 from anti-HIV_Chain
caggugagacuggagcagagcggcgccgccaugagaaagcccggcgccagcgugacccugagcugccaggccagcggcuacaacuucgugaaguacaucgugcacugggugagacagaagcccggccugggcuucgagugggugggcaugaucgaccccuacagaggcagacccuggagcgcccacaaguuccagggcagacugagccugagcagagacaccagcauggagauccuguacaugacccugaccagccugaagagcgacgacaccgccaccuacuucugcgccagagccgaggccgccagcgacagccacagcagacccaucauguucgaccacuggggccagggcagcagagugaccgugagcagcgccagcaccaagggc

SEQ ID NO: 35025 - RNA, 390 nt, Artificial Sequence
  derived and/or modified sequence opt4 from anti-HIV_Chain
caggugagacuggagcagagcggcgccgccaugagaaagcccggcgccagcgugacccugagcugccaggccagcggcuacaacuucgugaaguacaucauccacugggugagacagaagcccggccugggcuucgagugggugggcaugaucgaccccuacagaggcagacccuggagcgcccacaaguuccagggcagacugagccugagcagagacaccagcauggagauccuguacaugacccugaccagccugaagagcgacgacaccgccaccuacuucugcgccagagccgaggccgccagcgacagccacagcagacccaucauguucgaccacuggggccagggcagcagagugaccgugagcagcgccagcaccaagggc

SEQ ID NO: 35026 - RNA, 390 nt, Artificial Sequence
  derived and/or modified sequence opt4 from anti-HIV_Chain
caggugagacuggagcagagcggcaacgccgugagaaagcccggcgccagcgugaccaucagcugccaggccagcggcuacaacuucgugaaguucuucauccacugggugagacagagacccggccagggcuucgagugggugggcaugaucgagcccuucagaggcagacccuggagcgccggcaacuuccagggcagacugagccugagcagagacgugagcaccgagacccuguacaugacccugaacaaccugagaagcgacgacaccgccguguacuucugcgccagacuggaggccgagagcgacagccacagcagacccaucauguucgaccacuggggccacggcagccuggugaccgugagcagcgccagcaccaagggc

SEQ ID NO: 35027 - RNA, 390 nt, Artificial Sequence
  derived and/or modified sequence opt4 from anti-HIV_Chain
caggugagacuggagcagagcggcgccgccgugagaaagcccggcgccagcgugacccugagcugccaggccagcggcuacaacuucgugagauacaucauccacugggugagacagagacccggccuggacuucgagugggugggcaugaucgaccccuacagaggcagacccuggagcgcccacaaguucggcggcagacugagccugaccagagacgugagcaccgagauccuguacaugacccugaccagccugagaagcgacgacaccgccaccuacuucugcgccagagccgaggccgagagccagagccacagcagacccaucauguucgacagcuggggccagggcagcagagugaccgugagcagcgccagcaccaagggc

SEQ ID NO: 35028 - RNA, 390 nt, Artificial Sequence
  derived and/or modified sequence opt4 from anti-HIV_Chain
caggugagacuggagcagagcggcgccgccgugagaaagcccggcgccagcgugacccugagcugccaggccagcggcuacaacuucgugaacuacaucauccacugggugagacagagacccggccuggacuucgagugggugggcaugaucgaccccuacagaggcagacccuggagcgcccacaaguuccagggcagacugagccugagcagagacgugagcaccgagauccuguacaugacccugagcagccugagaagcgacgacaccgccaccuacuucugcgccagagccgaggccgagagccagagccacagcagacccaucauguucgacuucuggggccagggcagcagagugaccgugagcagcgccagcaccaagggc

SEQ ID NO: 35029 - RNA, 390 nt, Artificial Sequence
  derived and/or modified sequence opt4 from anti-HIV_Chain
caggugagacuggagcagagcggcaccgccgugagaaagcccggcgccagcgugaccaucagcugccaggccagcggcuacaacuucgugaaguucuucauccacugggugagacagagacccggccagggcuucgagugggugggcaugaucgagcccuucagaggcagacccuggagcgccggcaacuuccagggcagacugagccugagcagagacgugagcaccgagacccuguacaugacccugaacaaccugagaagcgacgacaccgccguguacuucugcgccagacuggaggccgagagcgacagccacagcagacccaucauguucgaccacuggggccacggcagccuggugaccgugagcagcgccagcaccaagggc

SEQ ID NO: 35030 - RNA, 390 nt, Artificial Sequence
  derived and/or modified sequence opt4 from anti-HIV_Chain
caggugagacuggagcagagcggcgccgccaugagaaagcccggcgccagcgugacccugagcugccaggccagcggcuacaacuucgugaaguacaucgugcacugggugagacagaagcccggccugggcuucgagugggugggcaugaucgaccccuacagaggcagacccuggagcgcccacaaguuccagggcagacugagccugagcagagacaccagcauggagauccuguacaugacccugaccagccugaccagcgacgacaccgccaccuacuucugcgccagagccgaggccgccagcgacagccacagcagacccaucauguucgaccacuggggccagggcagcagagugaccgugagcagcgccagcaccaagggc

SEQ ID NO: 35031 - RNA, 390 nt, Artificial Sequence
  derived and/or modified sequence opt4 from anti-HIV_Chain
gaggugcagcuggugcagagcggcggcggccuggugcagcccggcggcagccugagacugagcugcgccgccagcggccugaccuucagaaacuucgccaugagcugggugagacaggcccccggcaagggccuggagugggugagcagcaucagcggcagcggcggcagcaccuacuacgccgacagcgugaagggcagauucaccaucagcagagacaacagcaagaacacccuguaccugcagaugaacagccugagaggcgaggacaccgccguguacuucugcgccaagggcgugggcuacgacauccugaccggccugggcgacgccuucgacaucuggggccagggcaccgugguggccgugagcagcgccagcaccaagggc

SEQ ID NO: 35032 - RNA, 393 nt, Artificial Sequence
  derived and/or modified sequence opt4 from anti-HIV_Chain
caggugcagcuggugcagagcggcgccgccgugagaaagcccggcgccagcgugaccgugagcugcaaguucgccgaggacgacgacuacagcccccacugggugaaccccgcccccgagcacuacauccacuuccugagacaggcccccggccagcagcuggaguggcuggccuggaugaaccccaccaacggcgccgugaacuacgccuggcagcugcacggcagacugaccgccaccagagacggcagcaugaccaccgccuuccuggaggugagaagccugagaagcgacgacaccgccguguacuacugcgccagagcccagaagagaggcagaagcgagugggccuacgcccacuggggccagggcacccccgugcuggugagcagc

SEQ ID NO: 35033 - RNA, 393 nt, Artificial Sequence
  derived and/or modified sequence opt4 from anti-HIV_Chain
caggugcagcugcagcaguggggcgccggccugcugaagcccagcgagacccugagccugaccugcgccguguacgccggcagcuucagcggcuacuacuggaccuggaucagacagccccccggcaagggccuggaguggaucggcgaggugaaccacggcggcagcaccaacuacaaccccagccugaagagcagagugacccugagcguggacaccagcaagaaccaguucagccugaagcugaccagcgugaccgccgccgacaccgccguguacuacugcgccagagugagcagauacgacuucuggagcggcaacuacggcagcuacggccuggacguguggggccagggcaccaccgugaccgugagcagcgccagcaccaagggc

SEQ ID NO: 35034 - RNA, 393 nt, Artificial Sequence
  derived and/or modified sequence opt4 from anti-HIV_Chain
gaggugcagcuggugcagagcggcggcggcguggugcagcccggcagaagccugagacugagcugcguggugagcggcuucaccuucagcagcuucaccuuccacugggugagacaggcccccggcaagggccuggaguggguggccggcaugagcuuccacgccaccuacaucuacuacgccgacagcgugaagggcagauucaccaucagcagagacgacagccaggacacccuguaccuggagauggacagccugagaagcgaggacaccgccaucuacuacugcgccagagaccccggcauccacgacuacggcgacuacgcccccggcgccuucgacuacuggggccagggcagccccgugaccgugagcagcgccagcaccaagggc

SEQ ID NO: 35035 - RNA, 393 nt, Artificial Sequence
  derived and/or modified sequence opt4 from anti-HIV_Chain
caggugcagcuggugcagagcggcaccgaggugcagaagcccggcgccagcgugaaggugagcugcaagaccagcggcuacaccuucagcaaguacuacauccacugggugagacaggcccccggccagggccuggagugggugggcagaaucaacaccgacagcggcggcaccgacuacgccgagaaguuccagggcagagugaccaugaccagagacaccagcaucaccaccguguaccuggagaugagaggccugaccagcgacgacaccgccgccuucuacugcgccagaggccccccccacgccggcggcuggaccaucuacuacuacggccuggacguguggggccagggcaccagcgugaucgugagcagcgccagcaccaagggc

SEQ ID NO: 35036 - RNA, 393 nt, Artificial Sequence
  derived and/or modified sequence opt4 from anti-HIV_Chain
agaaccguggugacccagccccccagcgugagcggcgcccccggccagagagugaccaucagcugcaccggcagcagcagcaacaucggcgccggcuacgacgugcacugguaccagcagcugcccggcaccgcccccaagcugcugaucuacggcaacagcaacagacccagcggcgugcccgacagauucagcggcagcaagagcggcaccagcgccagccuggccaucaccggccugcaggccgaggacgaggccgacuacuacugccagagcuacgacagcagccugagcggcagcggcguguucggcaccggcaccaaggugaccgugcugggccagcccaaggccaaccccaccgugacccuguucccccccagcagcgaggagcug

SEQ ID NO: 35037 - RNA, 393 nt, Artificial Sequence
  derived and/or modified sequence opt4 from anti-HIV_Chain
caggugcagcugcagcaguggggcagcggccugcugaagcccagcgagacccugagccugaccugcgccguguacggcggcagcuucagaagcuacuacuggaacuggaucagacagagccccggcaagggccuggaguggaucggcgaggugagccacagcggcagcaccaacuacaaccccgcccugaagagcagagugaccaucagcguggacaccagcaagaaccaguucagccugaaggugaagagcgugaccgccgccgacaccgcccuguacuacugcagcagaggcagaggcaagagaugcagcggcgccuacugcuucgccggcuacuucgacagcuggggccagggcggccuggugguggugagcagcgccagcaccaagggc

SEQ ID NO: 35038 - RNA, 393 nt, Artificial Sequence
  derived and/or modified sequence opt4 from anti-HIV_Chain
caggugcaccuggugcagagcggcgccgaggugaagaagcccggcagcagcgugagagugagcugcgaggccagcggcuggaccuucggcagcgugaacagcgccaucaccugggugagacaggcccccggccagggccuggaguggaugggcagaaccauccccuuccugggcaucagcaacuacgcccagaaguuccagggcagagugaccaucaccgccgacaagagcaccaacaucgccuacguggacgugaccagccugaccagccaggacaccgccguguacuacugcgccagacugaucaccggcaugaccgcccccugguucuacuacauggacguguggggcaagggcaccaccgugaccgugagcagcgccagcaccaagggc

SEQ ID NO: 35039 - RNA, 393 nt, Artificial Sequence
  derived and/or modified sequence opt4 from anti-HIV_Chain
caggugcaccugcaggagagcggccccagacuggugagaagcagcgagacccugagccugaccugcagcgugcccggcggcagcaucgugaaccccaucaccaacuacuacuggagcuggaucagacagagccccagaaagggccugcaguggaucggcgacaucuacuacaccggcaccagcagcagaaaccccagccuggacagcagagugagcaucagcauggacgugagcagaaagcagaucagccugacccuguacagcgugaccgccgccgacaccgccgugcacuacugcgccagccagagccugagcugguacagacccagcggcuacuucgagagcuggggccagggcauccuggugaccgugagcagcgccagcaccaagggc

SEQ ID NO: 35040 - RNA, 393 nt, Artificial Sequence
  derived and/or modified sequence opt4 from anti-HIV_LightChain
augaagcugcccgugagacugcuggugcugauguucuggauccccgccagcagcagcgacaucgugaugacccagagcccccugagccugcccgugacccccggcgagcccgccagcaucagcugcagaagcagccagagacugcugagcagcuacggccacaccuaccugcacugguaccugcagaagcccggccagagcccccagcugcugaucuacgaggugagcaacagauucagcggcgugcccgacagauucagcggcagcggcagcggcaccgacuucacccugaagaucagcagaguggaggccgaggacgugggcguguacuacugcagccagagcacccacgugccccugaccuucggccagggcaccaagguggagaucaag

SEQ ID NO: 35041 - RNA, 396 nt, Artificial Sequence
  derived and/or modified sequence opt4 from anti-HIV_Chain
caggugcagcugcaggagagcggccccggccuggugaagcccagcgagacccugagcgugaccugcagcgugagcggcgacagcaugaacaacuacuacuggaccuggaucagacagagccccggcaagggccuggaguggaucggcuacaucagcgacagagccagcgccaccuacaaccccagccugaacagcagaguggugaucagcagagacaccagcaagaaccagcugagccugaagcugaacagcgugacccccgccgacaccgccguguacuacugcgccaccgccagaagaggccagagaaucuacggcguggugagcuucggcgaguucuucuacuacuacagcauggacguguggggcaagggcaccaccgugaccgugagcagc

SEQ ID NO: 35042 - RNA, 396 nt, Artificial Sequence
  derived and/or modified sequence opt4 from anti-HIV_Chain
caggugcagcugcaggagagcggccccggccuggugaagccccccgagacccugagccugaccugcagcgugagcggcgccagcgugaacgacgccuacuggagcuggaucagacagagccccggcaagagacccgagugggugggcuacgugcaccacagcggcgacaccaacuacaaccccagccugaagagaagagugaccuucagccuggacaccgccaagaacgaggugagccugaagcugguggcccugaccgccgccgacagcgccguguacuucugcgccagagcccugcacggcaagagaaucuacggcaucguggcccugggcgagcuguucaccuacuucuacauggacguguggggcaagggcaccaccgugaccgugagcagc

SEQ ID NO: 35043 - RNA, 396 nt, Artificial Sequence
  derived and/or modified sequence opt4 from anti-HIV_Chain
caggugcagcugcaggagagcggccccggccuggugaagcccagcgagacccugagccugaccugcagcgugagcggcgccagcaucagcgacagcuacuggagcuggaucagaagaagccccggcaagggccuggaguggaucggcuacgugcacaagagcggcgacaccaacuacagccccagccugaagagcagagugaaccugagccuggacaccagcaagaaccaggugagccugagccugguggccgccaccgccgccgacagcggcaaguacuacugcgccagaacccugcacggcagaagaaucuacggcaucguggccuucaacgagugguucaccuacuucuacauggacguguggggcaacggcacccaggugaccgugagcagc

SEQ ID NO: 35044 - RNA, 396 nt, Artificial Sequence
  derived and/or modified sequence opt4 from anti-HIV_Chain
caggugcaccugcaggagagcggccccggccuggugaagcccagcgagacccugagccugaccugcaacgugagcggcacccuggugagagacaacuacuggagcuggaugagacagccccugggcaagcagcccgaguggaucggcuacgugcacgacagcggcgacaccaacuacaaccccagccugaagagcagagugcaccugagccuggacaagagcaacaaccuggugagccugagacugaccgccgugaccgccgccgacagcgccaccuacuacugcgccaccaccaagcacggcagaagaaucuacggcaucguggccuucaacgagugguucaccuacuucuacauggacguguggggcaagggcaccaccgugaccgugagcagc

SEQ ID NO: 35045 - RNA, 396 nt, Artificial Sequence
  derived and/or modified sequence opt4 from anti-HIV_Chain
caggugcagcugcaggagagcggccccggccuggugaagcccagcgagacccugagcgugaccugcagcgugagcggcgacagcaugaacaacuacuacuggaccuggaucagacagagccccggcaagggccuggaguggaucggcuacaucagcgacagagagagcgccaccuacaaccccagccugaacagcagaguggugaucagcagagacaccagcaccaaccagcugagccugaagcugaacagcgugacccccgccgacaccgccguguacuacugcgccaccgccagaagaggccagagaaucuacggcguggugagcuucggcgaguucuucuacuacuacagcauggacguguggggcagaggcaccaccgugaccgugagcagc

SEQ ID NO: 35046 - RNA, 396 nt, Artificial Sequence
  derived and/or modified sequence opt4 from anti-HIV_Chain
caggugcagcugguggagagcggccccggccuggugacccccagcgagacccugagccugaccugcaccgugagcaacggcagcgugagcggcagauucuggagcuggaucagacagagccccggcagaggccuggaguggaucggcuacuucagcgacaccgacagaagcgaguacagccccagccugagaagcagacugacccugagccuggacgccagcagaaaccagcugagccugaagcugaagagcgugaccgccgccgacagcgccaccuacuacugcgccagagcccagcagggcaagagaaucuacggcaucgugagcuucggcgaguucuucuacuacuacuacauggacgccuggggcaagggcaccgccgugaccgugagcagc

SEQ ID NO: 35047 - RNA, 396 nt, Artificial Sequence
  derived and/or modified sequence opt4 from anti-HIV_Chain
caggugcagcugcaggagagcggccccggccuggugaagccccccgagacccugagccugaccugcagcgugagcggcgccagcaucaacgacgccuacuggagcuggaucagacagagccccggcaagagacccgagugggugggcuacgugcaccacagcggcgacaccaacuacaaccccagccugaagagaagagugaccuucagccuggacaccgccaagaacgaggugagccugaagcugguggaccugaccgccgccgacagcgccguguacuucugcgccagagcccugcacggcaagagaaucuacggcaucguggcccugggcgagcuguucaccuacuucuacauggacguguggggcaagggcaccaccgugaccgugagcagc

SEQ ID NO: 35048 - RNA, 396 nt, Artificial Sequence
  derived and/or modified sequence opt4 from anti-HIV_Chain
caggugcagcugcaggagagcggccccggccuggugaagccccccgagacccugagccugaccugcagcgugagcggcgccagcaucaacgacgccuacuggagcuggaucagacagagccccggcaagagacccgagugggugggcuacgugcaccacagcggcgacaccaacuacaaccccagccugaagagaagagugagcuucagccuggacaccgccaagaacgaggugagccugaagcugguggaccugaccgccgccgacagcgccaucuacuucugcgccagagcccugcacggcaagagaaucuacggcaucguggcccugggcgagcuguucaccuacuucuacauggacguguggggcaagggcaccaccgugaccgugagcagc

SEQ ID NO: 35049 - RNA, 396 nt, Artificial Sequence
  derived and/or modified sequence opt4 from anti-HIV_Chain
caggugcagcugcaggagagcggccccggccuggugaagcccagcgagacccugagcgugaccugcagcgugagcggcgacagcaugaacaacagcuacuggaccuggaucagacagagccccggcaagggccuggaguggaucggcuacaucagcaagagcgagagcgccaacuacaaccccagccugaacagcagaguggugaucagcagagacaccagcaagaaccagcugagccugaagcugaacagcgugacccccgccgacaccgccguguacuacugcgccaccgccagacacggccagagaaucuacggcguggugagcuucggcgaguucuucaccuacuacagcauggacguguggggcaagggcaccaccgugaccgugagcagc

SEQ ID NO: 35050 - RNA, 396 nt, Artificial Sequence
  derived and/or modified sequence opt4 from anti-HIV_Chain
caggugcagcugcaggagagcggccccggccuggugaagcccagcgagacccugagccugaccugcagcgugagcaacggcagcgugagcggcagauucuggagcuggaucagacagagccccggcagaggccuggaguggaucggcuacuucagcgacaccgagaagagcaacuacaaccccagccugagaagcagacugacccugagcguggacgccagcaagaaccagcugagccugaagcugaacagcgugaccgccgccgacagcgccaccuacuacugcgccagaacccagcagggcaagagaaucuacggcguggugagcuucggcgaguucuuccacuacuacuacauggacgccuggggcaagggcaccgccgugaccgugagcagc

SEQ ID NO: 35051 - RNA, 396 nt, Artificial Sequence
  derived and/or modified sequence opt4 from anti-HIV_Chain
caggugcagcuggugcagagcggcaccgcccugaagagccccggcagcagcgccaagcugagcugcaccgugcugggcgacgaguucggcaccuacuucaucagcuggaucagacaggcccccggccagggccuggagugggugggcggcaucgugccccacagccagcugcagagcagcgcccagaaguuccacggcagaaucaucaucagcgccggcgccggcgugaccccccccguggugagccugcagcugaccaaccugaccuucgaggacaccggcaccuacuucugcgccagagagagaggcagacacagagaccccaagaccggcgacgcccugagaggcagauacuucgacuucuggggcagaggcaccggcgugagcgugagcgcc

SEQ ID NO: 35052 - RNA, 396 nt, Artificial Sequence
  derived and/or modified sequence opt4 from anti-HIV_Chain
caggugcagcuggugcagagcggcaccgcccugaagagccccggcagcagcgccaagcugagcugcaccgugcugggcgacgaguucggcaccuacuucaucagcuggaucagacaggcccccggccagggccuggagugggugggcggcaucgugccccacagccagcugcagagcagcgcccagaaguuccacggcagaaucaucaucagcgccggcgccggcgugaccccccccguggugagccugcagcugaccaaccugaccuucgaggacaccggcaccuacuucugcgccagagagagaggcagacacagagaccccaagaccggcaaggcccccagaggcagauacuucgacuucuggggcagaggcaccggcgugaccgugagcgcc

SEQ ID NO: 35053 - RNA, 396 nt, Artificial Sequence
  derived and/or modified sequence opt4 from anti-HIV_Chain
caggugcagcuggugcagagcggcaccgcccugaagagccccggcagcagcgccaagcugagcugcaccgugcugggcgacgaguucggcaccuacuucaucagcuggaucagacaggcccccggccagggccuggagugggugggcggcaucgugccccacagccagcugcagagcagcgcccagaaguuccacggcagaaucaccaucagcgccggcgccggcgugaccccccccguggugagccugcagcugaccaaccugaccuucgaggacaccggcaccuacuucugcgccagagagagaggcagacacagagaccccaagaccggcgacgcccugagaggcagauacuucgacuucuggggcagaggcaccggcgugagagugagcacc

SEQ ID NO: 35054 - RNA, 396 nt, Artificial Sequence
  derived and/or modified sequence opt4 from anti-HIV_Chain
caggugcagcuggugcagagcggcgccgccgugaagagccccggcagcagcgccaagcugagcugcaccgugcugggcgacgaguucggcaccuacuucaucagcuggaucagacaggcccccggccagggccuggagugggugggcggcaucgugccccacagccagcugcagagcagcgcccagagauuccacggcagaaucaccaucagcgccggcgccggcgugaccccccccguggugagccugcagcugaccaaccugaccuucgacgacgccggcaccuacuucugcgccagagagagaggcagacacagagaccccaagaccggcgacgcccugagaggcagauacuucgacuucuggggcagaggcaccggcaucagcgugagcccc

SEQ ID NO: 35055 - RNA, 396 nt, Artificial Sequence
  derived and/or modified sequence opt4 from anti-HIV_Chain
gaggugcagcuggugcagagcggcgccgaggugaagaagcccggcgccagcgugaaggugagcugcaaggugagcggcuacacccugaccgagcugagcauccacugggugagacaggcccccggcaagggccuggaguggaugggcggcuucgaccccgaggacgacgaggccaucuacgagcccaaguuccagggcagacugaccaugaccgaggacaccagcaccgacaccgccuacauggagcugagcagccugagaagcgaggacaccgccguguacuacugcgccaccgccgaccccuucaagguggcccaggacgagggccuguacgugaucuucgacuacuggggccagggcacccuggugaccgugagcagcgccagcaccaagggc

SEQ ID NO: 35056 - RNA, 396 nt, Artificial Sequence
  derived and/or modified sequence opt4 from anti-HIV_Chain
gaggugcagcugguggagagcggcggcggccugcugcagcccggcggcagccugagacugagcugcgccgccagcggcuucagcuucaacgacuucgagaugaacugggugagacaggcccccggcaagggccuggagugggugagcuacaucagcaacgacggcaccaugauccacuacgccgacagcgugaagggcagauucaccaucagcagagacaacgccaagaagagccuguuccugcagaugaacagccugagagccgaggacaccgccguguacuacugcgccagacuggccgaggugccccccgccaucagaggcagcuacuacuacggcauggacguguggggccagggcaccaccgugaccguggccagcgccagcaccaagggc

SEQ ID NO: 35057 - RNA, 396 nt, Artificial Sequence
  derived and/or modified sequence opt4 from anti-HIV_Chain
caggugcagcugaugcagagcggcgccgaggugaagagacccggcgccagcgugaaggugagcugcaaggccuucagacacagccugaacaaccugggcaucagcuggaucagaagagcccccggcagaggccuggaguggcugggcuggaucaacguguacgagggcaacaccaaguacggcagaagauuccagggcagagugaccaugaccaccgacagaagcaccaacaccgugagcauggagcugagaagccugaccagcgacgacaccgccguguacuacugcgccagagacaaccacuucuggagcggcagcagcagauacuacuacuucggcauggacguguggggccagggcaccaccgugaucgugagcagcgccagcaccaagggc

SEQ ID NO: 35058 - RNA, 396 nt, Artificial Sequence
  derived and/or modified sequence opt4 from anti-HIV_Chain
caggugcagcuggugcaguggggcgccggccugcugaagccccuggagacccugagccugaccugcgccguguacggcggcagcuucaacggcuacuucuggagcuggaucagacagacccccggcaagggccuggaguggaucggcgagaucaaccacggcggcagcgccaacuucaaccccagccugaagagcagagugaccaugagcguggacaccagcaagaaccaguucagccugaagcuggccagcgugaccgccgccgacaccgccaucuacuacugcgccagaggcagaaucaccauggugagaggcgacccccagagaggcggcgugagaauggacguguggggccagggcaccagcgugaccgugagcagcgccagcaccaagggc

SEQ ID NO: 35059 - RNA, 396 nt, Artificial Sequence
  derived and/or modified sequence opt4 from anti-HIV_Chain
cuggugcagcuggugcagagcggcgccgaggugaagaagcccggcgccagcgugaaggugagcugcaaggugagcggccacacccugagcgagcugagcaucaacugggugagacacgugcccggcaagggccuggaguggaugggcggccuggaccccgaggacggcgaggccauccacgagcccaaguuccagggcagacugaccaugaccgaggacaccagcaccgacaccgccuacagcacccugagcgugugggcccccguggccgccgccauguacuacugcgccaccgccgaccccuucaagguggcccaggacgagggccuguacgugaucuucgacuacuggggccagggcacccuggugaccgugagcagcgccagcaccaagggc

SEQ ID NO: 35060 - RNA, 396 nt, Artificial Sequence
  derived and/or modified sequence opt4 from anti-HIV_Chain
caggugcagcugcugcagagcggcggcgaggugaagaagcccggcgccagcgugaaggugagcugcaaggugagcggcuacacccugaccgagcugagcauccacugggugagacaggcccccggcaagggccuggaguggaugggcggcuucgaccccgaggacgacgaggccaucuacgagcccaaguuccagggcagacugaccaugaccgaggacaccagcaccgacaccgccuacauggagcugagcagccugagaagcgaggacaccgccguguacuacugcgccaccgccgaccccuucaagguggcccaggacgagggccuguacgugaucuucgacuacuggggccagggcacccuggugaccgugagcagcgccagcaccaagggc

SEQ ID NO: 35061 - RNA, 396 nt, Artificial Sequence
  derived and/or modified sequence opt4 from anti-HIV_Chain
caggugcagcuggugcagagcggcgccgaggugaagaagcccggcgccagcgugaaggugagcugcaaggugagcggcuacacccugaccgagcugagcauccacugggugagacaggcccccggcaagggccuggaguggaugggcggcuucgacagcgaggacggcgaggccuucuacaagcagaacuuccagggcagagugaccaugaccgaggacaccagcaccgacaccgccuacauggagcugagaagacugagaagcgaggacaccgccguguacuacugcgccaccgccgacagauucaagguggcccaggacgagggccuguucgugaucuucgacuacuggggccagggcacccuggugaccgugagcagcgccagcaccaagggc

SEQ ID NO: 35062 - RNA, 396 nt, Artificial Sequence
  derived and/or modified sequence opt4 from anti-HIV_Chain
caggugcaccuggugcagagcggcgccgaggugaagaagcccggcgccagcgugagagugagcugcaaggccagcggcuacaccuucaccaccuacggcaucagcugggugagacaggcccccggccagggccuggaguggaugggcuggaucagcgcccacagcggcgacaccaacuacgcccagaagcugcaggccagagugaccaugaccaccgacaccagcaccaacaccgccuacauggagcugagaagccugaccagcgacgacaccgccguguacuacugcgccagagacagacccagacacuacuacgacagaggcggcuacuacagccccuucgacuacuggggccagggcacccuggugaccgugagcagcgccagcaccaagggc

SEQ ID NO: 35063 - RNA, 396 nt, Artificial Sequence
  derived and/or modified sequence opt4 from anti-HIV_Chain
cuggugcagcugcugcagagcggcgccgaggugaagaagcccggcgccagcgugaaggugagcugcaaggugagcggcuacacccugaccgagcugagcauccacugggugagacaggcccccggcaagggccuggaguggaugggcggcuucgaccccgaggacgacgaggccaucuacgagcccaaguuccagggcagacugaccaugaccgaggacaccagcaccgacaccgccuacauggagcugagcagccugagaagcgaggacaccgccguguacuacugcgccaccgccgaccccuucaagguggcccaggacgagggccuguacgugaucuucgacuacuggggccagggcacccuggugaccgugagcagcgccagcaccaagggc

SEQ ID NO: 35064 - RNA, 396 nt, Artificial Sequence
  derived and/or modified sequence opt4 from anti-HIV_Chain
caggugcagcuggugcagagcggcgccgaggugaagaagcccggcgccagcgugaaggugagcugcaaggugagcggccacacccugagcgagcugagcaucaacugggugagacacgugcccggcaagggccuggaguggaugggcggccuggaccccgaggacggcgaggccauccacgagcccaaguuccagggcagacugaccaugaccgaggacaccagcaccgacaccgccuacguggagcugagcagccugagaagcgaggacaccgccauguacuacugcgccaccgccgaccccuucaagguggcccaggacgagggccuguacgugaucuucgacuacuggggccagggcacccuggugaccgugagcagcgccagcaccaagggc

SEQ ID NO: 35065 - RNA, 396 nt, Artificial Sequence
  derived and/or modified sequence opt4 from anti-HIV_Chain
caggugcagcugcugcagagcggcgccgaggugaagaagcccggcgccagcgugaaggugagcugcaaggugagcggcuacacccugaccgagcugagcaucaacugggugagacaggcccccggcaagggccuggaguggaugggcggcuucgaccccgaggacgacgaggccaucuacgagcccaaguuccagggcagacugaccaugaccgaggacaccagcaccgacaccgccuacauggagcugagcagccugagaagcgaggacaccgccguguacuacugcgccaccgccgaccccuucaagguggcccaggacgagggccuguacgugaucuucgacuacuggggccagggcacccuggugaccgugagcagcgccagcaccaagggc

SEQ ID NO: 35066 - RNA, 396 nt, Artificial Sequence
  derived and/or modified sequence opt4 from anti-HIV_Chain
cagccccagcuggugcagagcggcagcggcgccgaggugaagaagcccggcgccagcgugagaaucagcugcgaggccagcgaguacaacguguucgaccacuucaugcagugggugagacaggcccccggccagggccuggaguggaugggcuggaucaaccccagaggcggcuaccccagcuacagccccaccuuccagggcagacugaccuucaccagacagcccagcugggacgacagcaccaucaccuuccacauggagcugagaggccugggccacgacgacaccgccguguacuacugcgccagaccccacagccccgacgacgccuggagccuggacguguggggcagaggcacccuggugaccgugagcagcgccagcaccaagggc

SEQ ID NO: 35067 - RNA, 396 nt, Artificial Sequence
  derived and/or modified sequence opt4 from anti-HIV_Chain
cagccccagcuggugcagagcggcagcggcgccgaggugaagaagcccggcgccagcgugagaaucagcugcgaggccagcgaguacaacguguucgaccacuucaugcagugggugagacaggcccccggccagggccuggaguggaugggcuggaucaaccccagaggcggcuaccccagcuacagccccagauuccagggcagacugaccuucaccagacagcccagcugggacgacagcagcgugaccuuccacauggagcugagaggccugagacacgacgacaccgccguguacuacugcgccagaccccacagccccgacgacgccuggagccuggacguguggggcagaggcacccuggugaccgugagcagcgccagcaccaagggc

SEQ ID NO: 35068 - RNA, 396 nt, Artificial Sequence
  derived and/or modified sequence opt4 from anti-HIV_Chain
gaggugcagcugguggagagcggcggcggcgugguggagcccggcgagagccugagacugagcugcgccgccagcggcuucaccuucagaagcuacgacauguucugggugagacaggccaccggcaagagccuggagugggugagcgccaucggcaucgccggcgacaccuacuacagcggcagcgugaagggcagauucaccaucagcagagagaacgccagaaccagccuguaccugcagcugagcggccugagaguggaggacagcgccguguacuucugcgugagaggcagcccccccagaaucgccgccaccgaguacaacuacuacuacggccuggacguguggggccagggcaccaccgugagcguguucagcgccagcaccaagggc

SEQ ID NO: 35069 - RNA, 396 nt, Artificial Sequence
  derived and/or modified sequence opt4 from anti-HIV_Chain
caggugcagcuggugcagagcggcgccgaggugaagaagcccggcagcagcgugaaggugagcugcaaggccagcggcggcaccuucaccaccuacgacaucagcugggugagacaggcccccggccagggccuggaguggaugggcggcauccugcccgacuucggcgcccccagcuacgcccagaaguuccaggacagagugaccaucaccaccgacgagagcagcagcaccgccuacauggagcugaacagccugagaagcgaggacaccgccaucuacuacugcgccagaggcagaggcgacgacuucuggagcggcgagagccccagcugguacuucgacuacuggggccagggcacccuggugaccgugagcagcgccagcaccaagggc

SEQ ID NO: 35070 - RNA, 396 nt, Artificial Sequence
  derived and/or modified sequence opt4 from anti-HIV_Chain
cagccccagcuggugcagagcggcagcggcgccgaggugaagaagcccggcgccagcgugagaaucagcugcgaggccagcgaguacaacguguucgaccacuucaugcagugggugagacaggcccccauggagggccuggaguggaugggcuggaucaaccccagaggcggcuaccccagcuacagccccaccuuccagggcagacugaccuucaccagacagcccagcugggacgacagcaccaucaccuuccacauggagcugagaggccugagacacgacgacaccgccguguacuacugcgccagaccccacagccccgacgacgccuggagccuggacguguggggcagaggcacccuggugaccgugagcagcgccagcaccaagggc

SEQ ID NO: 35071 - RNA, 396 nt, Artificial Sequence
  derived and/or modified sequence opt4 from anti-HIV_Chain
gaggugagacugcuggagagcggcggcggccuggugcagcccggcggcagccugagacugagcugcagcgccagcggcuucaccuucagcaacagcgcccugagcugggugagacaggcccccggcaagggccuggagugggugagcagcguggugagcagcggcggcgacaccuucuacgccgacagcgugaagggcagauucaccaucagcagagacaacagcagaaacacccuguaccugcagaugaagagccugagagccgaggacaccgcccuguacuacugcgccaaggugcagauccagcagcugaacuucggcgugaucaccgacgccggcauggacguguggggcaagggcaccaccgugaucgugagcagcgccagcaccaagggc

SEQ ID NO: 35072 - RNA, 396 nt, Artificial Sequence
  derived and/or modified sequence opt4 from anti-HIV_Chain
caggugcagcugguggagagcggcggcggcguggugcagcccggcagaagccugagacugagcugcgugggcagcggcuucaccuucagcagcagcggcaugcacugggugagacaggcccccggcaagggccuggaguggguggccgugaucagcagcgacggcagcgacgaguacuacggcgacagcguggagggcagauucaccaucagcagagacaacagcaagaacacccuguuccugcagcuggacagccuggaggccgaggacagcgccguguacuacugcgccaagacccccccccacuacgacgcccugaccggcuaccccagcagcgugcuggaguucuggggccugggcacccuggugaccgugagcagcgccagcaccaagggc

SEQ ID NO: 35073 - RNA, 396 nt, Artificial Sequence
  derived and/or modified sequence opt4 from anti-HIV_Chain
gaggugcagcuggugcagagcggcgccgaggugaagaagcccggcagcagcgugaaggugagcugcaaggccagcggcggcaccuucaccaccuacgacaucagcugggugagacaggcccccggccagggccuggaguggaucggcggcauccugcccgacuucggcgcccccagcuacgcccagaaguuccaggacagagugaccaucaccaccgacgagagcagcagaaccgccuacauggagcugaacagccugagaagcgaggacaccgccaucuacuacugcgccagaggcagaggcgacgacuucuggagcggcgagagccccagcugguacuucgacuacuggggccagggcacccaggugaccgugagcagcgccagcaccaagggc

SEQ ID NO: 35074 - RNA, 396 nt, Artificial Sequence
  derived and/or modified sequence opt4 from anti-HIV_Chain
caggugcagcugcugcagagcggcaccgaggugaagaagcccggcagcagcgugaaggugagcugcagagccagcggcuggacccugggcaacagccccaacagcgccaucggcugggugagacaggcccccggccagggccuggaguggaucggcagaaucauccccauccuggacgugaccaacuacgcccagaaguuccagggcagagugaccaucagcgccgacaagagcaccaacaucgccuacauggagaucagcagccugggcagcgaggacaccgccuucuacuacugcgccagagugaucaccggcaugaccagccccugguacuucuacauggacguguggggcgagggcaccaccgugaucgugagcagcgccagcaccaagggc

SEQ ID NO: 35075 - RNA, 396 nt, Artificial Sequence
  derived and/or modified sequence opt4 from anti-HIV_Chain
caggugcaccuggugcagagcggcgccgaggugaagaagcccggcagcagcgugagagugagcugcaaggccagcggcuggaccuucggcgacagcgugaacagcgccaucaccugggugagacaggcccccggccagggccuggaguggaugggcagauucauccccauccugggccugagcaacuacgcccagaaguuccaggacagagugaccaucaacguggacagaagcaccaacaccgccuacauggagcugagcggccugagaagcgaggacaccgccguguacuacugcgccagacugaucaccggcaugaacgcccccugguucuacuacauggacguguggggcaagggcaccaccaucaccgugagcagcgccagcaccaagggc

SEQ ID NO: 35076 - RNA, 396 nt, Artificial Sequence
  derived and/or modified sequence opt4 from anti-HIV_Chain
caggugcaccuggugcagagcggcgccgaggccaagagacccggcagcagcgugagagugagcugcagagccagcggcggcgacuucagcagcuacacccugagcugggugagacaggcccccggccagggccuggagagaaugggcggcguggugcccaugcuggacaccgugcacuacgcccagaaguuccagggcagacugacccugagcguggacgagggcaccagcaccgccuacauggagcugagcagccugagaagcgaggacaccgccauguacuacugcaccagaggcagacagaccuucagagccaucuggagcggcccccccgugguguucgacaucuggggccagggcacccuggugagcgugagcagcgccagcaccaagggc

SEQ ID NO: 35077 - RNA, 396 nt, Artificial Sequence
  derived and/or modified sequence opt4 from anti-HIV_Chain
caggugcaccuggugcagagcggcgccgaggccaagagacccggcagcagcgugagagugagcugcagagccagcggcggcgacuucagcagcuacacccugagcugggugagacaggcccccggccagggcaucgaguggaugggcggcguggugcccaugcuggacaccgugcacuacgcccagaaguuccagggcagacugacccugagcguggacgagggcaccagcaccgccuacauggagcugagcagccugagaagcgaggacaccgccauguacuacugcaccagaggcagacagaccuucagagccaucuggagcggcccccccgccguguucgacaucuggggccagggcacccuggugaucgugagcagcgccagcaccaagggc

SEQ ID NO: 35078 - RNA, 396 nt, Artificial Sequence
  derived and/or modified sequence opt4 from anti-HIV_Chain
caggugcagcuggugcagagcggcgccgagcugaagaagcccggcagcagcgugaaggugagcugcaaggccagcggcggcaccuucaacaaccacaccuucaacugggugagacaggcccccggccagggccuggaguggaugggcagaaccauccccauccugggcagcagagacuacgccaagaccuuccaggacagagugaccaucaucgccgacaagagcaccagcaccguguaccuggagcugagaagacugaagagcgaggacaccggcguguacuacugcgccaccagcauguacuacuucgacagcggcggcuacuacagaaacaccgaccuggacaaguggggccagggcagccuggugaccgugagcagcgccagcaccaagggc

SEQ ID NO: 35079 - RNA, 396 nt, Artificial Sequence
  derived and/or modified sequence opt4 from anti-HIV_Chain
cagguguaccuggugcagagcggccccgagcugaagaagcccggcgccagcgugaagaucagcugcaaggccagcggcuacaacuuccccaaguacgccauccacugggugagacaggcccccggccagggccugcaguggaugggcuggaucaacggcgacaacggcgacgccagauacagccagaagcugcagggcagagugacccccagcaccgacaccagcgccagcgugguguacauggagcugaagagacugagaagcgaggacaccgccguguacuacugcgccagagcccuguaccccugggagaucggcggcgugcccagcaccaugggcgacgacuacuggggccagggcacccugaucaccgugagcagcgccagcaccaagggc

SEQ ID NO: 35080 - RNA, 396 nt, Artificial Sequence
  derived and/or modified sequence opt4 from anti-HIV_Chain
caggugcagcuggugcagagcggccccgagcugaugaagcccggcagcagcgugaaggugagcugcagagccagcggcgacaacuuccugaccagcaccuucaacuggcugagacaggcccccggccagagacuggaguggaugggcagauucauccccagccugggccugaucaccagcgcccccaaguucagcgacagacugaccaucaccgccgaccaggccacccugaccgccuacauggagcugaccggccugaccagcgaggacaccgcccuguacuacugcgccagaggccugugcagaggcggcaacugcagacugggccccagcggcuggcuggaccccuggggcagaggcacccaggugaccgugagcagcgccagcaccaagggc

SEQ ID NO: 35081 - RNA, 396 nt, Artificial Sequence
  derived and/or modified sequence opt4 from anti-HIV_Chain
ggcgugcacuuccagggccaccuggugcagagcggcggcggcgugaagaagcccggcagcagcgugaccaucagcugccuggccagcgaguacaccuucaccgaguucaccauccacuggaucagacaggcccccggccagggcccccuguggcugggccugaucaagagaagcggcagacugaugaccagcuacagauuccaggacagacugagccugagaagagacagaagcaccggcaccguguucauggagcugagaggccugagaaucgacgacaccgccguguacuacugcgccagagacggccugggcgagguggcccccgccuaccuguacggcaucgacguguggggccagggcagcaccgugaucgugaccagcgccagcaccagc

SEQ ID NO: 35082 - RNA, 396 nt, Artificial Sequence
  derived and/or modified sequence opt4 from anti-HIV_Chain
caggugcagcugcugcagagcggcgccgaggugaagaagcccggcgccagcgugaaggugagcugcaaggugagcggcuacacccugaccgagcugagcauccacugggugagacaggcccccggcaagggccuggaguggaugggcggcuucgaccccgaggacgacgaggccaucuacgagcccaaguuccagggcagacugaccaugaccgaggacaccagcaccgacaccgccuacauggagcugagcagccugagaagcgaggacaccgccguguacuacugcgccaccgccgaccccuucaagguggcccaggacgagggccuguacgugaucuucgacuacuggggccagggcacccuggugaccgugagcagcgccagcaccaagggc

SEQ ID NO: 35083 - RNA, 396 nt, Artificial Sequence
  derived and/or modified sequence opt4 from anti-HIV_Chain
caggugcagcuggugcagagcggcgccgaggugaagaagcccggcgccagcgugaaggugagcugcaaggugagcggcuacacccugaccgagcugagcauccacugggugagacaggcccccggcaagggccuggaguggaugggcggcuucgaccccgaggacggcgaggccagcuucgagcccaaguuccagggcagacugaccaugaccgaggacaccagcaccgacaccgccuacauggagcugagcagccugagaagcgaggacaccgccguguacuacugcgccaccgccgaccccuucaagguggcccaggacgagggccuguacgugaucuucgacuacuggggccagggcacccuggugaccgugagcagcgccagcaccaagggc

SEQ ID NO: 35084 - RNA, 396 nt, Artificial Sequence
  derived and/or modified sequence opt4 from anti-HIV_Chain
ggcgugcacuuccagggccaccuggugcagagcggcggcggcgugaagaagcccggcagcagcgugaccaucagcugccuggccagcgaguacaccuucaccgaguucaccauccacuggaucagacaggcccccggccagggcccccuguggcugggccugaucaagagaagcggcagacugaugaccagcuacagauuccaggacagacugagccugagaagagacagaagcaccggcaccguguucauggagcugagaggccugagaaucgacgacaccgccguguacuacugcgccagagacggccugggcgagguggcccccgccuaccuguacggcaucgacguguggggccagggcaccaccgugaucgugaccagcgccagcaccagc

SEQ ID NO: 35085 - RNA, 396 nt, Artificial Sequence
  derived and/or modified sequence opt4 from anti-HIV_Chain
caggugcagcugggcgagagcggcggcggccugguggagcccggcggcagccugagacugagcugcgccgccagcggcuuccuguucagcgacuaccagaugagcuggaucagacuggcccccggcaagggccuggaguggaucagcuucaucagcggcuucggcagcguguacuacgccgacagcguggagggcagauucaccaucagcagagacaacgccagaaacagccuguaccugcagaugaacaaccugagagccgaggacaccgccguguacuacugcgccagagccuacggcaccggcaacuggagaggccuguacuacuacuacuacggcauggacguguggggccacggcaccaccgugaccgugagcagcgccagcaccaagggc

SEQ ID NO: 35086 - RNA, 399 nt, Artificial Sequence
  derived and/or modified sequence opt4 from anti-HIV_Chain
caggugcagcuggugcagagcggcaccgcccugaagagccccggcagcagcgccaagcugagcugcaccgugcugggcgacgaguucggcaccuacuucaucagcuggaucagacaggcccccggccagggccuggagugggugggcggcaucgugccccacagccagcugcagagcagcgcccagaaguuccacggcagaaucaucaucagcgccggcgccggcgugaccccccccguggugagccugcagcugaccaaccugaccuucgaggacaccggcaccuacuucugcgccagagagagaggcagacacagagaccccaagaccggcgacgcccugagaggcagauacuucgacuucuggggcagaggcaccggccugagagugagcaccagc

SEQ ID NO: 35087 - RNA, 399 nt, Artificial Sequence
  derived and/or modified sequence opt4 from anti-HIV_Chain
gaggugcagcuggugcagagcggcggcggccuggugaagcccggcggcagccugagacugagcugcgccgccagcggcuucaccuucaagaacgccuggaugagcugggugagacaggcccccggcaagggccuggagugggugggccacaucaagagcaagaccgacggcggcaccaucgacuacgccgcccccgugaagggcagauucaccaucagcagagacgacagcaagaacacccuguaccugcagaugaacagccugaagaucgaggacaccgccguguacuacugcaccaccgacaucggcagcggcagaggcugggacuuccacuacuacgacagcaacgacuggggccagggcacccuggugaccgugagcagcgccagcaccaagggc

SEQ ID NO: 35088 - RNA, 399 nt, Artificial Sequence
  derived and/or modified sequence opt4 from anti-HIV_Chain
caggugcagcugguggagagcggcggcggcguggugcagcccggcagaagccugagacuguucugcgccgccagcggcuucgccuucaacaccuacggcaugcacugggugagacaggcccccggcaagggccuggaguggguggccgugaccuggcacgacggcagccagaaguacuacgccgacagcgugaagggcagauucaccaucagcagagacaacagcaagaacacccuguaccugcagaugaacagccugagagccgaggacaccgccaucuacuacugcgccagcgaccagggcggcuucgacgacagcagcggcuacuucgcccccggcggcauggacguguggggcagaggcaccaccgugaucgugagcagcgcccccaccaagggc

SEQ ID NO: 35089 - RNA, 399 nt, Artificial Sequence
  derived and/or modified sequence opt4 from anti-HIV_Chain
ggcuacagcgaggugcagcuggugcagagcggccccggccuggugaagcccagccagacccugagccugaccugcaccgugagcggcggcagcaucagcaacggcggccacuacuggaacuggaucagacagcaccccggcaagggccuggaguggaucggccacaucuacaacaucgccaccaccuacuacaaccccagccugaagagcagagugagcaucagcguggacaccagcaagaaccaguucagccugaagcugagcagcgugaccgccgccgacaccgccguguacuacugcgccagaggcagcggcagauggaccaucggcgccagaaucuacuucgacaacuggggccagggcgcccugguggccgugagcagcgccagcaccaagggc

SEQ ID NO: 35090 - RNA, 399 nt, Artificial Sequence
  derived and/or modified sequence opt4 from anti-HIV_Chain
cagcugcagcugaaggagagcggccccggcauggugaagcccagcgagacccugagccugaccugcagcgugagcggcgccagcguggugagcgccaacgacuacuggggcuggaucagacaggcccccggcaagggccuggagugcaucggcaucauccuguacaccggcagcaccuucuacaaccccagccugcagagcagagugaccaucagcagagaccccagcaagaaccacgugagccugacccugaccagcgugaccgccgccgacagcgccguguacuacugcgccagaauccccuaccacagcgagagcuacuacaacguggugaucggcggcuucgacguguggggccagggcaccagagugaccgugagcagcgccagcaccaagggc

SEQ ID NO: 35091 - RNA, 399 nt, Artificial Sequence
  derived and/or modified sequence opt4 from anti-HIV_Chain
ugccaggugcagcugguggagagcggcggcggcguggugcagcccggcagaagccugagacugagcugcgugggcagcggcuucaccuucagcagcagcggcaugcacugggugagacaggcccccggcaagggccuggaguggguggccgugaucagcagcgacggcagcgacgaguacuacggcgacagcguggagggcagauucaccaucagcagagacaacagcaagaacacccuguuccugcagcuggacagccuggaggccgaggacagcgccguguacuacugcgccaagacccccccccacuacgacgcccugaccggcuaccccagcagcgugcuggaguucuggggccugggcacccuggugaccgugagcagcgccagcaccaagggc

SEQ ID NO: 35092 - RNA, 399 nt, Artificial Sequence
  derived and/or modified sequence opt4 from anti-HIV_Chain
caggugcagcuggugcagagcggcgccgacgugaagaagcccggcgccagcgugaaggugagcugcaaggugagcggcuacaccgugagcgagcugagcauccacugggugagacaggcccccggcaagggccuggaguggaugggcggcuucgaccccgaggacggcaagaccgugagcgcccagaacuuccagggcagagugaccaugaccgaggacaagagcaccggcaccgccaacauggagcugagaagccugagaagcgaggacaccgccguguacuacugcgccaccaccgugcagcugaucguggacuucugcaacggcggccccugcuacaacuucgacgacuggggccagggcacccuggugaccgugagcagcgccagcaccaagggc

SEQ ID NO: 35093 - RNA, 399 nt, Artificial Sequence
  derived and/or modified sequence opt4 from anti-HIV_Chain
ggccuggaccuggagcacgacggccaccacaaggaggagcccagagccagcgugaccgugagcugcgaggccagcggcuacaacuucgugaacuacaucauccacugggugagacugacccccggcagaggcuucgaguggaugggcaugaucgaccccagaagaggcagacccuggagcgcccagaaguuccagggcagacugacccugaccagagacaucgacagcgagagacuguacaugcagcugagcggccugagaggcgacgacaccgccguguacuucugcgccagacaggagcccgacuuccacgacggccacggccacacccugagaggcauguucgacagcuggggccagggcagccccgugagcgugagcagcgccagcaccaagggc

SEQ ID NO: 35094 - RNA, 399 nt, Artificial Sequence
  derived and/or modified sequence opt4 from anti-HIV_Chain
caggugagacuggugcagagcggcgcccagcugaagaagcccggcgccagcgugaccgugagcugcgaggccagcggcuacaacuucgugaacuacaucaucaacugggugagacagacccccggcagaagcuucgagugggugggcaugaucgaccccagaagaggcagacccuggagcgcccagaaguuccagggcagacugacccugaccagagacaucgacagcgagaagcuguacaugcaccugagcggccugagaggcgacgacaccgccguguacuacugcgccagacaggacagcgacuuccacgacggccacggccacacccugagaggcauguucgacagcuggggccagggcagccccgugaccgugagcagcgccagcaccaagggc

SEQ ID NO: 35095 - RNA, 399 nt, Artificial Sequence
  derived and/or modified sequence opt4 from anti-HIV_Chain
caggugagacugagccagagcggcgccgccguggugaagaccggcgccagcgugaccaucagcugcgagaccgagggcuacaccuucgugaacuacaucauccacugggugagacagccccccggcagaggcuucgaguggcugggcaugaucgaccccagaaacggccaccccugguucggccagagauucagaggcagacugagccugagaagagacagaagcaccgagaccguguucaugacccugagcggccugaccagcgacgacaacggcaucuacuucugcgccagaaacgagccccaguacuacgacggcagcggccacagccugcccggcauguucgacuacuggggccagggcaccagagugguggugagcagcgccagcaccaagggc

SEQ ID NO: 35096 - RNA, 399 nt, Artificial Sequence
  derived and/or modified sequence opt4 from anti-HIV_Chain
caggugagacugagccagagcggcgccgccgugaugaagaccggcgccagcgugaccaucagcugcgagaccgagggcuacaacuucgugaacuacaucauccacugggugagaagaccccccggcagaggcuucgaguggcugggcaugaucgaccccaagaacggccaccccugguucgcccaggccgugagaggcagacugagccugagaagagacaccuucaacgaggugguguacaugacccugagcggccugaccagcgacgacaccggccuguacuucugcgccagaaacgagccccaguaccacgacggcaacggccacagccugcccggcauguucgacuucuggggccagggcacccuggugaccgugagcagcgccagcaccaagggc

SEQ ID NO: 35097 - RNA, 399 nt, Artificial Sequence
  derived and/or modified sequence opt4 from anti-HIV_Chain
caggugagacugagccagagcggcgccgccguggugaagaccggcgccagcgugaccaucagcugcgagaccgagggcuacaccuucgugaacuacaucauccacugggugagacagccccccggcagaggcuucgaguggcugggcaugaucgaccccagaaacggccaccccugguucggccagagacugcagggcagacugagccugagaagagacagaagcaccgagaccguguucaugacccugagcggccugaccagcgacgacaccggcaucuacuucugcgccagaaacgagccccaguacuacgacggcagcggccacagccugcccggcauguucgacuacuggggccagggcaccagagugguggugagcagcgccagcaccaagggc

SEQ ID NO: 35098 - RNA, 399 nt, Artificial Sequence
  derived and/or modified sequence opt4 from anti-HIV_Chain
caggugagacugagccagagcggcgccgccguggugaagaccggcgccagcgugaccaucagcugcgagaccgagggcuacaccuucgugaaccacaucauccacugggugagacagccccccggcagaggcuucgaguggcugggcaugaucgaccccagaaacggccaccccugguucggccagagacugagaggcagacugagccugagaagagacagaagcaccgagaccguguucaugacccugagcggccugaccagcgacgacaucggcaucuacuucugcgccagaaacgagccccaguacuucgacggcagcggccacagccugcccggcauguucgacuacuggggccagggcaccagagugguggugagcagcgccagcaccaagggc

SEQ ID NO: 35099 - RNA, 399 nt, Artificial Sequence
  derived and/or modified sequence opt4 from anti-HIV_Chain
caggugcaguucuuccagagcggcagcagcaugaagaagagcggcgccagcgugaccaucagcugcgaggccaccggcuacaacaucaagaaccacauccugcacugggugagacagaagcccggcagaggcuucgagugggugggcaugaucgaccccaucaacggcagacccugguucggccaggccuucagaggcagacugacccugaccagagaccugagcaccgagaccuucuacaugagccugagcggccugaccagcgacgacaccgccaccuacuucugcgccagaagagaggccgacuaccacgacggcaacggccacacccugcccggcauguucgacuucuggggccccggcacccuggugaccgugagcagcgccagcaccaagggc

SEQ ID NO: 35100 - RNA, 399 nt, Artificial Sequence
  derived and/or modified sequence opt4 from anti-HIV_Chain
caggugagacugagccagagcggcgccgccguggugaagaccggcgccagcgugaccaucagcugcgagaccgagggcuacaccuucgugaacuacaucauccacugggugagacagagccccggcagaggcuucgaguggcugggcaugaucgaccccagaaacggccaccccugguucggccagagacugagaggcagacugagccugagaagagacagaagcaccgagaccguguucaugacccugagcggccugaccagcgacgacaccgccaucuacuucugcgccagaaacgagccccaguacuacgacggcagcggccacagccugcccggcauguucgacuacuggggccagggcaccagagugguggugagcagcgccagcaccaagggc

SEQ ID NO: 35101 - RNA, 399 nt, Artificial Sequence
  derived and/or modified sequence opt4 from anti-HIV_Chain
caggugagacugagccagagcggcgccgccaugaagaagcccggcgccagcgugaccaucagcugcgagaccgagggcuacaccuucaucaacuacaucauccacugggugagacagccccccggcagaggcuucgaguggcugggcaugaucgaccccagaaacggcagacccugguucggccagagcgugcagggcagacugagccugagaagagacaccuacaccgaggugguguacaugacccugagcggccugaccagcgacgacgccggccuguacuucugcgccagaaacgagccccaguaccacgacggcaacggccacagccugcccggcauguucgacuacuggggccagggcacccugguggccgugagcagcgccagcaccaagggc

SEQ ID NO: 35102 - RNA, 399 nt, Artificial Sequence
  derived and/or modified sequence opt4 from anti-HIV_Chain
caggugagacuggugcagagcggcgcccagcugaagaagcccggcgccagcgugaccgugagcugcgaggccagcggcuacaacuucgugaacuacaucaucaacugggugagacagacccccggcagaggcuucgagugggugggcaugaucgaccccagaagaggcagacccuggagcgcccagaaguuccagggcagacugacccugaccagagacaucgacagcgagaagcuguacaugcaccugagcggccugagaggcgacgacaccgccguguacuacugcgccagacaggacagcgacuuccacgacggccacggccacacccugagaggcauguucgacagcuggggccagggcagccccgugaccgugagcagcgccagcaccaagggc

SEQ ID NO: 35103 - RNA, 399 nt, Artificial Sequence
  derived and/or modified sequence opt4 from anti-HIV_Chain
caggugcacaccuuccagagcggcagcagcaugaagaagagcggcgccagcgugaccaucagcugcgaggccaccggcuacaacaucaagaacuacauccugcacugggugagacagaagcccggcagaggcuucgagugggugggcaugaucgaccccaucaacggcagacccugguucggccagcccuucagaggcagacugacccugaccagagaccugagcaccgagaccuucuacaugagccugagcggccugaccagcgacgacaccgccaccuacuucugcgccagaagagaggccgacuaccacgacggcaacggccacacccugcccggcauguucgacuucuggggccccggcacccugaucaccgugagcagcgccagcaccaagggc

SEQ ID NO: 35104 - RNA, 399 nt, Artificial Sequence
  derived and/or modified sequence opt4 from anti-HIV_Chain
caggugagacuguuccagagcggcgccgccaugaagaagcccggcgccagcgugaccaucagcugcgaggccagcggcuacaacuucaugaacuacuucgugcacugggugagacagagacccggcagaggcuucgaguggcugggcaugaucaaccccagaggcggcagacccuggagcgcccagagcgugcagggcagacugacccugaccagagacaucagcaccgagauguucuacaugagacuggacggccugagaagcgacgacaccgccaccuacuucugcgccagaaacgaggccgacuaccacgacggcaacggccacagccugagaggcauguucgacuacuggggccagggcagccugaucaccgugagcagcgccagcaccaagggc

SEQ ID NO: 35105 - RNA, 399 nt, Artificial Sequence
  derived and/or modified sequence opt4 from anti-HIV_Chain
caggugcagcuguuccagagcggcgccgccaugagaaagcccggcgccagcgugaccaucagcugcgaggccagcggcuacaacuucaugaacuacuucgugcacugggugagacagagacccggcagaggcuucgaguggcugggcaugaucaaccccagaggcggcagacccuggagcgcccagagcgugcagggcagacugacccugaccagagacaccagcaccgagauguucuacaugagacuggacggccugagaagcgacgacaccgccaccuacuucugcgccagaaacgaggccgacuaccacgacggcaacggccacagccugagaggcauguucgacuacuggggccagggcagccugaucaccgugagcagcgccagcaccaagggc

SEQ ID NO: 35106 - RNA, 399 nt, Artificial Sequence
  derived and/or modified sequence opt4 from anti-HIV_Chain
caggugagacugagccagagcggcgccgccaucaagaagcccggcgccagcgugaccaucagcugcgagaccgagggcuacaccuucaucaacuacaucauccacugggugagacagccccccggcagaggcuucgaguggcugggcaugaucgaccccagaaacggcagacccugguucggccagagcgugcagggcagacugagccugagaagagacaccuacaccgaggugguguacaugacccugagcggccugaccagcgacgacaccggccuguacuucugcgccagaaacgagccccaguaccacgacggcaacggccacagccugcccggcauguucgacagcuggggccagggcacccugguggccgugagcagcgccagcaccaagggc

SEQ ID NO: 35107 - RNA, 399 nt, Artificial Sequence
  derived and/or modified sequence opt4 from anti-HIV_Chain
caggugagacuguuccagagcggcgccgccaugagaaagcccggcgccagcgugaccaucagcugcgaggccagcggcuacaacuuccugaacuacuucgugcacugggugagacagagacccggcagaggcuucgaguggcugggcaugaucaaccccagaggcggcagacccuggagcgcccagagcgugcagggcagacugacccugaccagagacaccagcaccgagauguucuacaugagacuggacggccugagaagcgacgacaccgccaccuacuucugcgccagaaacgaggccgacuaccacgacggcaacggccacagccugagaggcauguucgacuacuggggccagggcagccugaucaccgugagcagcgccagcaccaagggc

SEQ ID NO: 35108 - RNA, 399 nt, Artificial Sequence
  derived and/or modified sequence opt4 from anti-HIV_Chain
caggugagacugagccagagcggcgccgccgugaagaagcccggcgccagcgugaccaucgugugcgagaccgagggcuacaacuucaucgacuacaucauccacugggugagacagccccccggcagaggcuucgaguggcugggcaugaucgaccccagaaacggcagacccuggagcggccagaaggugcacggcagacugagccuguggagagacaccagcaccgagaagguguacaugacccugaccggccugaccagcgacgacaccggccuguacuucugcggcagaaacgagccccaguaccacgacgacaacggccacagccugcccggcaugaucgacuacuggggccagggcaccauggugaccgugagcagcgccagcaccaagggc

SEQ ID NO: 35109 - RNA, 399 nt, Artificial Sequence
  derived and/or modified sequence opt4 from anti-HIV_Chain
caggugagacugagccagagcggcgccgccaucaagaagcccggcgccagcgugaccaucagcugcgagaccgagggcuacaccuucaucaacuacaucauccacugggugagacagccccccggcagaggcuucgaguggcugggcaugaucgaccccagaaacggcagacccugguucggccagagcgugcagggcagacugagccugagaagagacaccuacaccgaggugguguacaugacccugagcggccugaccagcgacgacgccggccacuacuucugcgccagaaacgagccccaguaccacgacggcaacggccacagccugcccggcauguucgacuacuggggccagggcacccugguggccgugagcagcgccagcaccaagggc

SEQ ID NO: 35110 - RNA, 399 nt, Artificial Sequence
  derived and/or modified sequence opt4 from anti-HIV_Chain
caggugagacuguuccagagcggcgccgccaugagaaagcccggcgccagcgugaccaucagcugcgaggccagcggcuacaacuucaugaacuacuucgugcacugggugagacagagacccggcagaggcuucgaguggcugggcaugaucaaccccagaggcggcagacccuggagcgcccagagcgugcagggcagacugacccugaccagagacaccagcaccgagauguucuacaugagacuggacggccugagaagcgacgacaccgccaccuacuucugcgccagaaacgaggccgacuaccacgacggcaacggccacagccugagaggcauguucgacuacuggggccagggcagccugaucaccgugagcagcgccagcaccaagggc

SEQ ID NO: 35111 - RNA, 399 nt, Artificial Sequence
  derived and/or modified sequence opt4 from anti-HIV_LightChain
augaagcugcccgugagacugcuggugcugauguucuggauccccgccagcagcagcgacaucgugaugacccagagcccccugagccugcccgugacccccggcgagcccgccagcaucagcugcagaagcagccagagacugcugagcagcuacggccacaccuaccugcacugguaccugcagaagcccggccagagcccccagcugcugaucuacgaggugagcaacagauucagcggcgugcccgacagauucagcggcagcggcagcggcaccgacuucacccugaagaucagcagaguggaggccgaggacgugggcguguacuacugcagccagagcacccacgugccccugaccuucggccagggcaccaagguggagaucaagagaaag

SEQ ID NO: 35112 - RNA, 402 nt, Artificial Sequence
  derived and/or modified sequence opt4 from anti-HIV_Chain
cagcccuacaucgugcagagcggccccgccgugaagggcgccggcagcagcgugaccgugaccugcaagguggacggcgacgacgacggcaucuucagcuucggcaccuacuucauggugugggugagacaggcccccggccagggccugcaguacaugggcggccuggugcccagcuacgcccccaccuacgcccacaaguucgagggcagaaucaccaucagcgccgccggcaccccccccguggugagccugacccugcugaaccugaccaacgacgacgccgccaccuacuucugcgccagagagagaggcagacacuacgacagcaagaccagagagaacagaagaggcagauacuucgacauguggggcagaggcaccagaaucaccgugagcccc

SEQ ID NO: 35113 - RNA, 402 nt, Artificial Sequence
  derived and/or modified sequence opt4 from anti-HIV_Chain
cagcccuacaucgugcagagcggccccgccgugaagggcgccggcagcagcgugaccgugaccugcagaguggacggcgacgacgacggcaucuucaacuucggcaccuacuucauggugugggugagacaggcccccggccagggccugcaguacaugggcggccuggugcccagcuacgcccccaccuacgcccacaaguucgagggcagaaucaccaucagcgccgccggcaccccccccguggugagccugacccugaucaaccugaccaacgccgacgccgccaccuacuucugcgccagagagagaggcagacacuacgacagcaagaccagagagaacagaagaggcagauacuucgacauguggggcagaggcaccagaaucaccgugagcccc

SEQ ID NO: 35114 - RNA, 402 nt, Artificial Sequence
  derived and/or modified sequence opt4 from anti-HIV_Chain
agagugcacagccaggugcagcugguggagagcggccccggccuggugaagcccagccagacccugagccugaccugcaccgugagcggcggcagcaucagcaacggcggccacuacuggaacuggaucagacagcaccccggcaagggccuggaguggaucggccacaucuacaacaucgccaccaccuacuacaaccccagccugaagagcagagugagcaucagcguggacaccagcaagaaccaguucagccugaagcugagcagcgugaccgccgccgacaccgccguguacuacugcgccagaggcagcggcagauggaccaucggcgccagaaucuacuucgacaacuggggccagggcgcccugguggccgugagcagcgccagcaccaagggc

SEQ ID NO: 35115 - RNA, 402 nt, Artificial Sequence
  derived and/or modified sequence opt4 from anti-HIV_Chain
agcguggacgagagacugcuggaguucggcggcagacuggugcagcccggcggcagccugagacugagcugcagcgccagcggcuucaccuucagcaacagcgccaugagcugggugagacaggcccccggcaagggccuggagugggugagcagcauccugagcagcggcgugggcaccuucuacgccgacagcgugaagggcagauucaccgugagcagagacaacagcagaaacacccuguaccugcagaugaagagccugagagccgaggacaccgcccuguacuacugcgccaaggugcagauccagcagcugaacuucggcgugaucaccgacgccggccuggacguguggggcaagggcaccacccugaucgugagcagcgccagcaccaagggc

SEQ ID NO: 35116 - RNA, 402 nt, Artificial Sequence
  derived and/or modified sequence opt4 from anti-HIV_Chain
gugcagagccagguguaccuggugcagagcggcggcgaggugaagaagcccggcagcagcgugaaggugagcugcaaggccagcggcgacagcuucagcagcagcgugaucaccugggugagacaggcccccggccagggccccgaguggaugggcagaaucauccccgugcugggcguggccgccuacgcccagaacuucuacggcagagugaccaucagcgccgacaccagcagcaacaccgccuacauggagcugagcagccugagauucgaggacaccgccguguucuacugcgccagagagaccggcagaggcggcaaccuggcccugagacaguacuucuucgacagcuggggccagggcacccuggugaccgugagcagccccagcaccaagggc

SEQ ID NO: 35117 - RNA, 402 nt, Artificial Sequence
  derived and/or modified sequence opt4 from anti-HIV_Chain
cagcugcagcugcaggagagcggccccggccuggugaagcccagcgagacccugagccugaccugcagcgugagcgacggcagcaucaacagcaacagcuacuacugggccuggaucagacagagccccggcaagggccuggaguggaucggcagcguguacuacuucggcggcaccuacuacagccccagccugaagagcagagugaccaugagcguggacagaagcaagaaccaguucagccugaacgugagcagcgugaccgccgccgacaccgccaucuacuacugcgccagacacgugagacccuacgacagaagcggcuaccccgagagacccaacugguucgaccccuggggcagaggcacccuggugaccgugagcagcgccagcaccaagggc

SEQ ID NO: 35118 - RNA, 402 nt, Artificial Sequence
  derived and/or modified sequence opt4 from anti-HIV_Chain
caggugcagcugcaccaguggggcgccggccugcugaagcccagcgacacccugagccugaccugcggcauccugggcgugagcccccccggcagccugaccggcuacuacuggaccuggaucagacagccccccggcaagggccuggaguggaucggcgagguguaccacagcggcagcaccaacuacaaccccagccuggccagcagagugaccaucagcaugggcaccaccaagacccaguucagccugagacugaccagcgugaccgccgccgacagcgccguguacuacugcgccagcggcaagguguggggcaucaccgccagacccagagacgccggccuggacguguggggccagggcaccaccgugaccgugaccagcgccagcaccaagggc

SEQ ID NO: 35119 - RNA, 402 nt, Artificial Sequence
  derived and/or modified sequence opt4 from anti-HIV_Chain
caggugcagcuggugcagagcggcgccgaggugaagaagcccggcagcagcgugaaggugagcugcagagccagcggcggcagcuucggcaacuacgccaucaacugggugagacaggcccccaugcagggccuggaguggaugggcggcaucauccccaucuucggcaccaccaacuacgcccagaacuucagaggcagagugaccaucaacgccgacaccuucaccaacaccgugaacauggaccugagcagccugagaagcgaggacaccgccguguacuacugcggcagaagcaucaacgccgccgugcccggccuggagggcguguacuacuacuacggcauggccguguggggccagggcaccaccgugaccgugagcagcgccagcaccaagggc

SEQ ID NO: 35120 - RNA, 402 nt, Artificial Sequence
  derived and/or modified sequence opt4 from anti-HIV_Chain
uucgugcagcugguggagagcggcggcggccuggugcagcccggcggcagccugagacugagcugcgccgccagcggcuucaacuucaacaccuacuggaugaacugggugagacaggcccccggcaagggccuggaguggguggccaacaugaaggaggacggcagcgagaaguacuacguggacagcgugaagggcagauucaccaucagcagagacaacgccaagaacagccuguaccugcagaugaacagccugagagccgaggacaccgccguguacuacugcgccagaaaccccgagagcagaugcaucgugggcagaaacagaggcuggugcagauacuucgaccuguggggcagaggcagccuggugaccgugagccccgccagcaccaagggc

SEQ ID NO: 35121 - RNA, 405 nt, Artificial Sequence
  derived and/or modified sequence opt4 from anti-HIV_Chain
cagcugcagcuggaccagcccggcgccgccaugaagagccugggcagcagccugaccaucaccugcagagugagcggcgacgaccugggcagcuuccacuucggcaccuacuucaugaucugggugagacagggccccggccagggccuggaguacaugggcggcauccugcccagcaccaagacccccaccuacgcccacaaguucagaggcagagugagcaucagcgcccccggcgugccccccgugcugagccuggcccugaccaaccugaccuacgacgacaccgccaccuacuucugcgccagagagagaggcagacacuucgagcccaagaacagagaccaccuggagggcaaguuccuggaccuguggggcagaggcaccuucgugagagugagcccc

SEQ ID NO: 35122 - RNA, 405 nt, Artificial Sequence
  derived and/or modified sequence opt4 from anti-HIV_Chain
caggugcagcuggugcagcccggcaccgccaugaagagccugggcagcagccugaccaucaccugcagagugagcggcgacgaccugggcagcuuccacuucggcaccuacuucaugaucugggugagacaggcccccggccagggccuggaguacaugggcggcauccugcccagcaccaagacccccaccuacgcccacaaguucagaggcagagugagcaucagcgcccccggcgugccccccgugcugagccuggcccugaccaaccugaccuacgacgacaccgccaccuacuucugcgccagagagagaggcagacacuucgagcccaagaacagagacaaccuggagggcaaguucuucgaccuguggggcagaggcaccuucgugagagugagcccc

SEQ ID NO: 35123 - RNA, 405 nt, Artificial Sequence
  derived and/or modified sequence opt4 from anti-HIV_Chain
caggugcagcuggugcagcccggcaccgccaugaagacccugggcagcagccugaccaucagcugcagagugagcggcgacgacggcaacuuccacuucggcaccuacuucauggccugggugagacaggugcccggccagggccuggaguacaugggcggcauccugcccagcaccaagagccccaccuacgcccacaaguucagaggcagagugagcaucagcaccgccggcgugccccccguggugagccuggcccugaccaaccugaccuacgacgacaccgccaccuacuucugcgccagagagagaggcagacacuacgacagcaagaagcaggagaacuacagaggcaaguucuucgaccuguggggcagaggcaccugggugagagugagccccacc

SEQ ID NO: 35124 - RNA, 405 nt, Artificial Sequence
  derived and/or modified sequence opt4 from anti-HIV_Chain
caccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagaaccugaccagcgacgacaccgccguguacuucugcaccaccaccagcaccuacgaccaguggagcggccugcaccacgacggcgugauggccuucagcagcuggggccagggcacccugaucagcgugagcgccgccagcaccaagggc

SEQ ID NO: 35125 - RNA, 405 nt, Artificial Sequence
  derived and/or modified sequence opt4 from anti-HIV_Chain
caggugcagcuggugcagagcggcgccgaggugaagaagcccggcagcagcgugaaggugagcugcaaggccagcggcggcaccuucagcaccuacgccuucagcugggugagacaggcccccaucgagggccuggaguggaugggcggcaucauccccaucuucggcaccgagaacuacgcccagaaguuccagggcagagugaccaucaccgccgacaagagcaccagcaccgccuacauggagcugagcagccugagaagcgaggacaccgccguguacuacugcgccagagacagaagcagcgccaucggcuacugcagcagcaucagcugcuacaagggcagcuucgacaucuggggccagggcaccauggugaccgugagcagcgccagcaccaagggc

SEQ ID NO: 35126 - RNA, 405 nt, Artificial Sequence
  derived and/or modified sequence opt4 from anti-HIV_Chain
caggugcagcuggugcagagcggcgccgaggugaagaagcccggcagcagcgugaaggugagcugcaaggccagcggcggcaccuucagcaccuacgccuucagcugggugagacaggcccccggccagggccuggaguggaugggcggcaucauccccaucuucggcaccgagaacuacgcccagaaguuccagggcagagugaccaucaccgccgacaagagcaccagcaccgccuacauggagcugagcagccugagaagcgaggacaccgccguguacuacugcgccagagacagaagcagcgccaucggcuacugcagcagcaucagcugcuacaagggcagcuucgacaucuggggccagggcaccauggugaccgugagcagcgccagcaccaagggc

SEQ ID NO: 35127 - RNA, 405 nt, Artificial Sequence
  derived and/or modified sequence opt4 from anti-HIV_Chain
gaggugcagcugguggagagcggcggcggccuggugcagcccggcggcagccugagacugagcugcgccgccagcggcuucaccuucagcagcuacagcaugaacugggugagacaggcccccggcaagggccuggagugggugagcuacaucagcggcagcagcuacaccaucuacuacgccgacagcgugagaggcagauucaccaucagcagagacaacgccaagaacagccuguaccugcagaugaacagccugagagacgaggacaccgccguguacuucugcgccagagccaccccccccaacccccugaaccuguacaacuacgacagcagcggcagcagcuucgacuacuggggccagggcacccuggugaccgugagcagcgccagcaccaagggc

SEQ ID NO: 35128 - RNA, 405 nt, Artificial Sequence
  derived and/or modified sequence opt4 from anti-HIV_Chain
gaggugcagcuggugcagagcggcgccgaggugaagaagcccggcagcagcgugaaggugagcugcaaggccagcggcggcaccuucagcaccuacgccuucagcugggugagacaggcccccggccagggccuggaguggaugggcggcaucauccccaucuucggcaccgagaacuacgcccagaaguuccagggcagagugaccaucaccgccgacaagagcaccagcaccgccuacauggagcugagcagccugagaagcgaggacaccgccguguacuacugcgccagagacagaagcagcgccaucggcuacugcagcagcaucagcugcuacaagggcagcuucgacaucuggggccagggcaccauggugaccgugagcagcgccagcaccaagggc

SEQ ID NO: 35129 - RNA, 405 nt, Artificial Sequence
  derived and/or modified sequence opt4 from anti-HIV_Chain
gaggugcagcugguggagagcggcgccgaggugaagaagcccggcagcagcgugaaggugagcugcaaggccagcggcggcaccuucagcaccuacgccuucagcugggugagacaggcccccggccagggccuggaguggaugggcggcaucauccccaucuucggcaccgagaacuacgcccagaaguuccagggcagagugaccaucaccgccgacaagagcaccagcaccgccuacauggagcugagcagccugagaagcgaggacaccgccguguacuacugcgccagagacagaagcagcgccaucggcuacugcagcagcaucagcugcuacaagggcagcuucgacaucuggggccagggcaccauggugaccgugagcagcgccagcaccaagggc

SEQ ID NO: 35130 - RNA, 405 nt, Artificial Sequence
  derived and/or modified sequence opt4 from anti-HIV_Chain
ccccuggugcagcuggagcccagcggcguggaggugaagaagagaggcgccagcgugaaggugagcugcaaggugagcggcuacagccugaccgagcugagcaugcacugggugagacaggcccccggcaagggccuggaguggaugggcagcuucgacccccuggacggcgacaccaucuacgcccagaaguuccagggcagagugaccaugaccguggacaccagcaccgacaccgccuacauggaccugagcagccugagauucgaggacaccgccguguacuacugcgccacccccagcaaggccuacuacuacgacagccccaacuacgagggcgacuucuacauggacguguggggcaagggcaccaccgugaucgugagcagcgccagcaccaagggc

SEQ ID NO: 35131 - RNA, 408 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagcugaccagcgacgacaccgccguguacuucugcaccaccaccagcaccuacgacaaguggagcggccugcaccacgacggcgugauggccuucagcagcagaggccagggcacccugaucagcgugagcgccgccagcaccaagggc

SEQ ID NO: 35132 - RNA, 408 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagggccuggaguacaucggccagaucuggagauggaagagcagcgccagccaccacuucagaggcagagugcugaucagcgccguggaccugaccggcagcagcccccccaucagcagccuggagaucaaggugaccagcgacgacaccgccguguacuucugcaccaccaccagcaccuacgacgaguggagcgaccugcaccacgacggcgugauggccuucagcagcuggggccagggcacccugaucagcgugagcgccgccagcaccaagggc

SEQ ID NO: 35133 - RNA, 408 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagcugaccagcgacgacaccgccguguacuucugcaccaccaccagcaccuacgacagauggagcggccugcaccacgacggcgugauggccuucagcagcuggggccagggcacccugaucagcgugagcgccgccagcaccaagggc

SEQ ID NO: 35134 - RNA, 408 nt, Artificial Sequence
  derived and/or modified sequence opt4 from anti-HIV_Chain
ugcaaccccagagugcacagcgaggugcagcugguggagagcggcgccgaggugaagaagcccggcgccagcgugaagguggccugcaaggugagcggcaagaagcugagcgaccugagcauccacugggugagacaggcccccggcaagggccuggaguggaugggcggcuucgacgaggaggacggcaagaucagcuacgagagaaaguuccagggcagagugagcaugaccgaggacaccgccagagacaccgccuucauggagaugagcagccugagaagcgacgacaccgccguguacuucugcgccgccgcccccagacuggaccugggcgagcugagcagcggcuuccacuucuggggccugggcacccuggugaccgugagcagcgccagcaccaagggc

SEQ ID NO: 35135 - RNA, 408 nt, Artificial Sequence
  derived and/or modified sequence opt4 from anti-HIV_Chain
aucugggccccccugaucgccgugaccuuccuggugcugcacugcgagagccugggcaccugcugcugcugccaggccagcggcggcaccuucaacaccuucgccaucaacugggugagacaggcccccggccagggccuggagugggugggcggcaucauccccguguucggcaccgccagcuacgcccagaaguuccagggcagagugaccgugaccaccgacgagagcagaggcaccgccuacauggagcugaacagccugagaagcgaggacaccgccguguacuacugcgccagaggccagaccgaccugaacgacgaccuguggagcgacuacagcacccccggcuucgacuacuggggccagggcacccuggugaccgugagcagcgccagcaccaagggc

SEQ ID NO: 35136 - RNA, 408 nt, Artificial Sequence
  derived and/or modified sequence opt4 from anti-HIV_Chain
cugcagcccagagugcacagcgaggugcagcugguggagagcggcgccgaggugaagaagcccggcgccagcgugaaggugagcugcaaggugagcggcuacacccugagcgaccugagcaugcacugggugagacaggcccccggcaagggccuggaguggaugggcggcuucgacgaggaggacggcgagaucaccuacgcccagaaguuccagggcagagugagcaugaccgaggacaccagcagagacaccgccuacauggagcugagcagccugagaagcgaggacaccgccguguacuacugcgccaccgcccccagacuggagcugggcgagcugagcagcggcuuccacuacuggggccugggcacccuggugaccgugagcagcgccagcaccaagggc

SEQ ID NO: 35137 - RNA, 408 nt, Artificial Sequence
  derived and/or modified sequence opt4 from anti-HIV_Chain
cagagccaggugcaccuggugcagagcggcgccgaggugaagaagcccggcagcagcgugaaggugagcugccaggccagcggcggcaccuucaacaccuucgccaucaacugggugagacaggcccccggccagggccuggagugggugggcggcaucauccccguguucggcaccgccagcuacgcccagaaguuccagggcagagugaccgugaccaccgacgagagcagaggcaccgccuacauggagcugaacagccugagaagcgaggacaccgccguguacuacugcgccagaggccagaccgaccugaacgacgaccuguggagcgacuacagcacccccggcuucgacuacuggggccagggcacccuggugaccgugagcagcgccagcaccaagggc

SEQ ID NO: 35138 - RNA, 408 nt, Artificial Sequence
  derived and/or modified sequence opt4 from anti-HIV_Chain
ggcagcgaggugcagcugguggagagcggcgccgaggugaagaagagaggcgccagcgugaaggugagcugcaaggugagcggcuacagccugaccgagcugagcaugcacugggugagacaggcccccggcaagggccuggaguggaugggcagcuucgacccccuggacggcgacaccaucuacgcccagaaguuccagggcagagugaccaugaccguggacaccagcaccgacaccgccuacauggaccugagcagccugagauucgaggacaccgccguguacuacugcgccacccccagcaaggccuacuacuacgacagccccaacuacgagggcgacuucuacauggacguguggggcaagggcaccaccgugaucgugagcagcgccagcaccaagggc

SEQ ID NO: 35139 - RNA, 408 nt, Artificial Sequence
  derived and/or modified sequence opt4 from anti-HIV_Chain
caggugcagcuggugcagagcggcggcgaggugaagaagcccggcgccagcgugaaggugagcugcaaggugagcggcuacagccugaccgagcugagcaugcacugggugagacaggcccccggcaagggccuggaguggaugggcguguucgacccccuggagggcgacggcguguacgugcagaaguucagaggcagagugaucaugaccgaggacaccagcaccgacaccgccuacauggagcugaccagccugagaagcgaggacaccgccaucuacuacugcgccaccaaggccaaggacuacuacuacgagagcagcgacuacagccccuacuacuacuacuacauggacguguggggcaagggcaccaccgugaccgugagcagcgccagcaccaagggc

SEQ ID NO: 35140 - RNA, 408 nt, Artificial Sequence
  derived and/or modified sequence opt4 from anti-HIV_Chain
gaggugcagcuggugcagagcggcgccgaggugaagaagcccggcgccagcgugaaggugagcugcaaggugagcggcuacacccugaccgagcugagcaugcacugggugagacaggcccccggcaagggccuggaguggaugggcguguucgacccccuggagggcgacggcguguacgccgagaaguucagaggcagagugaucaugaccgaggacaccagcaccgacaccggcuacauggagcugaccagccugagaagcgaggacaccgccaucuacuacugcgccaccaaggccaaggacuacuacuacgagagcagcgacuacagccccuacuacuacuacuacauggacguguggggcaagggcaccaccgugaccgugagcagcgccagcaccaagggc

SEQ ID NO: 35141 - RNA, 408 nt, Artificial Sequence
  derived and/or modified sequence opt4 from anti-HIV_Chain
caggugcagcuggugcagagcggcgccgaggugaagaagcccggcgccagcgugaaggugagcugcaaggccagcggcuacaccuucaccagauaccacauccacugggugagacacgcccccggccagggccuggaguggaugggcaagaucaaccccagcagagccagcaccaaguacgccaagaaguuccaggacagagugaccaugaccagagacaccagcaccagcaccguguacauggagcugagcagccugagaggcgacgacaccgccguguacuacugcggcagagagaugggcaccuucacccugcugggcguggugaucgaccacuacgacuucuaccccauggacguguggggccagggcacccccgugaccgugagcagcgccagcaccaagggc

SEQ ID NO: 35142 - RNA, 408 nt, Artificial Sequence
  derived and/or modified sequence opt4 from anti-HIV_Chain
agcagaccccccagcugccugcugggcugcuggugcugcagcggcuuccugcugcccgccgugauccugcccaaccugcacagccccugccugagccugcuggagagccagccccccagccuggccgaccuggugagcgccuucgccgugauggacauccccaucuacaucggcaccuacagaagccaggccagccugcacagcagcagcaccaaguuccccaccgacuuccugggcagccagaccggcagcguggccgugggccagggccagaucagccaccugagaagcguggaguggagacugagaaugugggaguucaucaccgcccugaaggugcacauguuccugagcagaagcgacagaggccccagauggaagaacgugagcagccugcugaacagcaga

SEQ ID NO: 35143 - RNA, 411 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugaucaucagcgccguggaccugaccggcagcagcccccccaucagcccccuggagaucaagaaccugaccagcgacgacaccgccguguacuucugcaccaccaccagcaccagcgacagauggagcggccugcaccacgacggcgugauggccuucagcagcuggggccagggcacccugaucagcgugagcgccgccagcaccaagggc

SEQ ID NO: 35144 - RNA, 411 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugaucaucagcgccguggaccugaccggcagcagcccccccaucagcagccuggagaucaagaaccugaccagcgacgacaccgccguguacuucugcaccaccgccagcaccuacgacaaguggagcggccugcaccacgacggcgugauggccuucagcagcuggggccagggcacccugaucagcgugagcgccgccagcaccaagggc

SEQ ID NO: 35145 - RNA, 411 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggccccagcccccccaucagcagccuggagaucaagaaccugaccagcgacgacaccgccguguacuucugcaccaccaccagcaccuacgacaaguggagcggccugcaccacgacggcgugauggccuucagcagcuggggccagggcacccugaucagcgugagcgccgccagcaccaagggc

SEQ ID NO: 35146 - RNA, 411 nt, Artificial Sequence
  derived and/or modified sequence opt4 from anti-HIV_HeavyChain
cagauccaccuggugcagagcggcaccgaggugaagaagcccggcagcagcguggccgugagcugcaaggccuacggcgugaacaccuucggccuguacgccgugaacugggugagacaggcccccggccagagccuggaguacaucggccagaucuggagauggaagagcagcgccagccacgacuucagaggcagagugaucaucagcgccguggaccugaccggcagcagcccccccaucagcagccuggagaucaagaaccugaccagcgacgacaccgccguguacuucugcaccgccaccagcacccccgacuacuggagcggccugcaccacgacggcgugauggccuucagcagcuggggccagggcacccugaucagcgugagcgccgccagcaccaagggc

SEQ ID NO: 35147 - RNA, 411 nt, Artificial Sequence
  derived and/or modified sequence opt4 from anti-HIV_HeavyChain
cagauccaccuggugcagagcggcaccggcgugaagaagcccggcagcagcgugaccgugagcugcaaggccuacggcgugaacaccuucggccuguacgccgugaacugggugagacaggcccccggccagggccuggaguacaucggccagaucuggagauggaagagcagcgccagccaccacuucagaggcagagugcugaucagcgccguggaccugaccggcagcagcccccccaucaccagccuggagaucaagaacgugaccagcgacgacaccgccguguacuucugcaccaccaccagcaccuacgacaaguggagcggccuguaccacgacggcgugauggccuucagcagcuggggccagggcacccugaucagcgugagcgccgccagcaccaagggc

SEQ ID NO: 35148 - RNA, 411 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugaucaucagcgccguggaccugaccggcagcagcccccccaucagcagccuggagaucaagaaccugaccagcgacgacaccgccguguacuucugcaccaccaccagcaccagcgacuacuggagcggccugcaccacgacggcgugauggccuucagcagcuggggccagggcacccugaucagcgugagcgccgccagcaccaagggc

SEQ ID NO: 35149 - RNA, 411 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagaaccugaccagcgacgacaccgccguguacuucugcaccaccaccagcaccuacgacagauggagcggccugcaccacgacggcgugauggccuucagcagcuggggccagggcacccugaucagcgugagcgccgccagcaccaagggc

SEQ ID NO: 35150 - RNA, 411 nt, Artificial Sequence
  derived and/or modified sequence opt4 from anti-HIV_HeavyChain
cagauccaccuggugcagagcggcaccgaggugagaaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagaaccugaccagcgacgacaccgccguguacuucugcaccaccaccagcaccuacgacaaguggagcggccugcaccacgacggcgugauggccuucagcagcuggggccagggcacccugaucagcgugagcgccgccagcaccaagggc

SEQ ID NO: 35151 - RNA, 411 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagaaccugaccagcgacgacaccgccguguacuucugcaccaccaccagcaccuacgaccaguggagcggccugcaccacgacggcgugauggccuucagcagcuggggccagggcacccugaucagcgugagcgccgccagcaccaagggc

SEQ ID NO: 35152 - RNA, 411 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugagcugggugagacaggcccccggccagagacuggaguacaucggccagaucagaagauggaagagcagcgccagccaccacuucagaggcagagugaccgugagcgccguggaccccaccggcagcagcccccccaucagcagccuggagaucagagaccugaccaccgacgacaccgccguguacuucugcaccaccaccagcaccagcgacuacuggagcggccugcacaacgagagaggcaccgccuucagcagcuggggccagggcacccugaucagcgugagcgccgccagcaccaagggc

SEQ ID NO: 35153 - RNA, 411 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagggccuggaguacaucggccagaucuggagauggaagagcagcgccagccaccacuucagaggcagagugcugaucagcgccaucgaccugaccggcagcagcccccccaucagcagccuggagaucaagaacgugaccagcgacgacaccgccguguacuucugcaccaccaugagcaccuacgacaaguggagcggccugcaccacgacggcgugauggccuucagcagcuggggccagggcacccugaucagcgugagcgccgccagcaccaagggc

SEQ ID NO: 35154 - RNA, 411 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacgaggugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagaacgugaccagcgacgacaccgccguguacuucugcaccaccaccagcacccacgacaaguggagcggccugcaccacgacggcgugauggccuucagcagcuggggccagggcacccugaucagcgugagcgccgccagcaccaagggc

SEQ ID NO: 35155 - RNA, 411 nt, Artificial Sequence
  derived and/or modified sequence opt4 from anti-HIV_HeavyChain
cagauccaccuggugcagagcggcaccgaggugaagaagcccggcagcagcgugaccgugagcugcaaggccuacggcgugaacaccuucggccuguacgccgugaacugggugagacaggcccccggccagggccuggaguacaucggccagaucuggagauggaagagcagcgccagccaccacuucagaggcagagugcugaucagcgccguggaccugaccggcagcagcccccccaucagcagccuggagaucaagaacgugaccagcgacgacaccgccguguacuucugcaccaccaccagcaccuacgacaaguggagcggccugcaccacgacggcgugguggccuucagcagcuggggccagggcacccugaucagcgugagcgccgccagcaccaagggc

SEQ ID NO: 35156 - RNA, 411 nt, Artificial Sequence
  derived and/or modified sequence opt4 from anti-HIV_Chain
caggugacccuggugcagagcggcgccgaggugaagaagcccggcgccagcgugagaaucagcugcagagccagcggcuucaccuucgacgacuacagcgacuacagcuucauccccaccaccuaccugauccacugguucagacaggcccccggccagggccuggaguggauggccuggaucaacagcgugaacggcggcagaaacaucgccagacaguuccagggcagagugaccguggccagagacagaagcaacagcaucgccuuccuggaguucagcggccugagacacgacgacaccgccguguacuucugcgccagagacagaagagacgacgacagagccuggcugcuggaccccuggggccagggcaccagagugaccgugagcagcgccagcaccaagggc

SEQ ID NO: 35157 - RNA, 411 nt, Artificial Sequence
  derived and/or modified sequence opt4 from anti-HIV_Chain
cagauccaccuggugcagagcggcaccgaggugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagaaccugaccagcgacgacaccgccguguacuucugcaccaccaccagcaccuacgacaaguggagcggccugcaccacgacggcgugauggccuucagcagcuggggccagggcacccugaucagcgugagcgccgccagcaccaagggc

SEQ ID NO: 35158 - RNA, 414 nt, Artificial Sequence
  derived and/or modified sequence opt4 from anti-HIV_Chain
guggugcagcuggugcagagcggcgccgaggugagaaagcccggcagcagccugaaggugagcugcaagagcagcggcggcaccuucagcagauucguggugaacugggugagacaggcccccggccagggccuggaguggaugggcggcaugauccccaucuucggcaucgccaaguacgcccagaaguuccaggacagagugaccaugaccgccgacgagagcaagaacaccguguaccuggacuucagcagccugagaagcgacgacaccgccguguacuacugcgccagagacagaggcgacaccagacugcuggacuacggcgacuacgaggacgagagauacuacuacggcauggacguguggggccagggcaccaccgugaucgugagcagcgccagcaccaagggc

SEQ ID NO: 35159 - RNA, 414 nt, Artificial Sequence
  derived and/or modified sequence opt4 from anti-HIV_Chain
caggugcagcuggugcagagcggcgccgaggugagaaagcccggcagcagccugaaggugagcugcaagagcagcggcggcaccuucagcagauucguggugaacugggugagacaggcccccggccagggccuggaguggaugggcggcaugauccccaucuucggcaucgccaaguacgcccagaaguuccaggacagagugaccaugaccgccgacgagagcaagaacaccguguaccuggacuucagcagccugagaagcgacgacaccgccguguacuacugcgccagagacagaggcgacaccagacugcuggacuacggcgacuacgaggacgagagauacuacuacggcauggacguguggggccagggcaccaccgugaucgugagcagcgccagcaccaagggc

SEQ ID NO: 35160 - RNA, 414 nt, Artificial Sequence
  derived and/or modified sequence opt4 from anti-HIV_Chain
gaggugcagcugguggagagcggcgccgaggugagaaagcccggcagcagccugaaggugagcugcaagagcagcggcggcaccuucagcagauucguggugaacugggugagacaggcccccggccagggccuggaguggaugggcggcaugauccccaucuucggcaucgccaaguacgcccagaaguuccaggacagagugaccaugaccgccgacgagagcaagaacaccguguaccuggacuucagcagccugagaagcgacgacaccgccguguacuacugcgccagagacagaggcgacaccagacugcuggacuacggcgacuacgaggacgagagauacuacuacggcauggacguguggggccagggcaccaccgugaucgugagcagcgccagcaccaagggc

SEQ ID NO: 35161 - RNA, 414 nt, Artificial Sequence
  derived and/or modified sequence opt4 from anti-HIV_Chain
caggugcagcugguggagagcggcgccgaggugagaaagcccggcagcagccugaaggugagcugcaagagcagcggcggcaccuucagcagauacguggugaacugggugagacaggcccccggccagggccuggaguggaugggcggcaucauccccaucuucggcaucgccaaguacgcccagaaguuccaggacagagugaccaugaccgccgacgagcccaagaacaccguguaccuggacuucaacagccugagaagcgacgacaccgccguguacuacugcgccagagacagaggcgacaccagacugcuggacuacggcgacuacgaggacgagagauacuacuacggcauggacguguggggccagggcaccaccgugaucgugagcagcgccagcaccaagggc

SEQ ID NO: 35162 - RNA, 414 nt, Artificial Sequence
  derived and/or modified sequence opt4 from anti-HIV_Chain
caggugcagcuggugcagagcggcgccgaggugagaaagcccggcagcagccugaaggugagcugcaagagcagcggcggcaccuucagcagauacguggugaacugggugagacaggcccccggccagggccuggaguggaugggcggcaugauccccaucuucggcaucgccaaguacgcccagaaguuccaggacagagugaccaugaccgccgacgagagcaagaacaccguguaccuggacuucagcagccugagaagcgacgacaccgccguguacuacugcgccagagacagaggcgacaccagacugcuggacuacggcgacuacgaggacgagagauacuacuacggcauggacguguggggccagggcaccaccgugaucgugagcagcgccagcaccaagggc

SEQ ID NO: 35163 - RNA, 414 nt, Artificial Sequence
  derived and/or modified sequence opt4 from anti-HIV_Chain
caggugcagcuggugcagagcggcgccgaggugagaaagcccggcagcagccugaaggugagcugcaagagcagcggcggcaccuucagcagauacguggugaacugggugagacaggcccccggccagggccuggaguggaugggcggcaucauccccaucuucggcaucgccaaguacgcccagaaguuccaggacagagugaccaugaccgccgacgagagcaagaacaccguguaccuggacuucagcagccugagaagcgacgacaccgccguguacuacugcgccagagacagaggcgacaccagacugcuggacuacggcgacuacgaggacgagagauacuacuacggcauggacguguggggccagggcaccaccgugaucgugagcagcgccagcaccaagggc

SEQ ID NO: 35164 - RNA, 414 nt, Artificial Sequence
  derived and/or modified sequence opt4 from anti-HIV_Chain
caggugcagcugguggagagcggcgccgaggugagaaagcccggcagcagccugaaggugagcugcaagagcagcggcggcaccuucagcagauacguggugaacugggugagacaggcccccggccagggccuggaguggaugggcggcaucauccccaucuucggcaucgccaaguacgcccagaaguuccaggacagagugaccaugaccgccgacgagagcaagaacaccguguaccuggacuucagcagccugagaagcgacgacaccgccguguacuacugcgccagagacagaggcgacaccagacugcuggacuacggcgacuacgaggacgagagauacuacuacggcauggacguguggggccagggcaccaccgugaucgugagcagcgccagcaccaagggc

SEQ ID NO: 35165 - RNA, 414 nt, Artificial Sequence
  derived and/or modified sequence opt4 from anti-HIV_Chain
caggugcagcuggugcagagcggcgccgaggugagaaagcccggcagcagccugaaggugagcugcaagagcagcggcggcaccuucagcagauacguggugaacugggugagacaggcccccggccagggccuggaguggaugggcggcaucauccccaucuucggcaucgccaaguacgcccagaaguuccaggacagagugaccaugaccgccgacgagcccaagaacaccguguaccuggacuucaacagccugagaagcgacgacaccgccguguacuacugcgccagagacagaggcgacaccagacugcuggacuacggcgacuacgaggacgagagauacuacuacggcauggacguguggggccagggcaccaccgugaucgugagcagcgccagcaccaagggc

SEQ ID NO: 35166 - RNA, 414 nt, Artificial Sequence
  derived and/or modified sequence opt4 from anti-HIV_Chain
guggugcagcuggugcagagcggcgccgaggugagaaagcccggcagcagccugaaggugagcugcaagagcagcggcggcaccuucagcagauacguggugaacugggugagacaggcccccggccagggccuggaguggaugggcggcaugauccccaucuucggcaucgccaaguacgcccagaaguuccaggacagagugaccaugaccgccgacgagagcaagaacaccguguaccuggacuucagcagccugagaagcgacgacaccgccguguacuacugcgccagagacagaggcgacaccagacugcuggacuacggcgacuacgaggacgagagauacuacuacggcauggacguguggggccagggcaccaccgugaucgugagcagcgccagcaccaagggc

SEQ ID NO: 35167 - RNA, 414 nt, Artificial Sequence
  derived and/or modified sequence opt4 from anti-HIV_Chain
uucaucugcuucagcgugguggugagacugcuggaguucggcggcagacuggugcagcccggcggcagccugagacugagcugcagcgccagcggcuucaccuucagcaacagcgccaugagcugggugagacaggcccccggcaagggccuggagugggugagcagcauccugagcagcggcgugggcaccuucuacgccgacagcgugaagggcagauucaccgugagcagagacaacagcagaaacacccuguaccugcagaugaagagccugagagccgaggacaccgcccuguacuacugcgccaaggugcagauccagcagcugaacuucggcgugaucaccgacgccggccuggacguguggggcaagggcaccacccugaucgugagcagcgccagcaccaagggc

SEQ ID NO: 35168 - RNA, 414 nt, Artificial Sequence
  derived and/or modified sequence opt4 from anti-HIV_Chain
caggugcagcuggugcagagcggcgccgaggugagaaagcccggcagcagccugaaggugagcugcaagagcagcggcggcaccuucagcagauacguggugaacugggugagacaggcccccggccagggccuggaguggaugggcggcaucauccccaucuucggcaucgccaaguacgcccagaaguuccaggacagagugaccaugaccgccgacgagagcaagaacaccguguaccuggacuucagcagccugagaagcggcgacaccgccguguacuacugcgccagagacagaggcgacaccagacugcuggacuacggcgacuacgaggacgagagauacuacuacggcauggacguguggggccagggcaccaccgugaccgugagcagcgccagcaccaagggc

SEQ ID NO: 35169 - RNA, 417 nt, Artificial Sequence
  derived and/or modified sequence opt4 from anti-HIV_Chain
caggugcagcugguggagagcggcgccgaggugaagaagcccggcagcagcgugaaggugagcugcaaggccagcggcggcaccuucaacaucuucgccuucagcugggugagacaggcccccggccagggccuggaguggaugggcggcaucauccccaucuucgccagccccaacuacgcccagagauuccagggcagagugaccaucaccgccgacgagagcaccagcaccgugcacauggagcugagcagccugagaagcgaggacaccgccaucuacuacugcgccaaggacgcccacaugcacaucgaggagcccagagacuacgacuacaucuggggcaccagccccuacuacuucgacuacuggggccagggcacccuggugaccgugagcagcgccagcaccaagggc

SEQ ID NO: 35170 - RNA, 417 nt, Artificial Sequence
  derived and/or modified sequence opt4 from anti-HIV_Chain
caggugcagcugguggagagcggcgccgaggugaagaagcccggcgccagcgugaaggugagcugcaaggccagcggcuacaccuucaccagccacgacaucaacugggugagacaggccaccggccagggccuggaguggaugggcuggaugaaccccaacagcggcgacaccggcuacgcccacaaguuccagggcagagugaccaugaccagaaacacccccaucagcaccgccuacauggagcugagcagccugagaagcgaggacaccgccguguacuacugcgccagaggcagagccaccagcagaaacacccccugggcccacuacuacgacagcagcggcuacuacggcgccggcgacuacuggggccagggcacccuggugaccgugagcagcgccagcaccaagggc

SEQ ID NO: 35171 - RNA, 417 nt, Artificial Sequence
  derived and/or modified sequence opt4 from anti-HIV_Chain
caggugcagaucagacagagcggccccggccuggugaagccccuggagacccugagccugagcugcaucguguucggcggcagcuucaucgccuaccacuggaccuggaucagacaggccccccugaagggccuggaguggaucggcgacaucgaccagggcggcgacaucaccuacagccccagccugaagagcagagugaccaugagcguggacagaagcaagagccaguucagccugaagcugagcagcgugaccgccgccgacgccgccguguacuacugcgugagaggcccccccaacagauacgccgugaccagcuucaccagcggcacccacagagagagaagcagcuacuacuucgacuacuggggccccggcacccuggugaccgugagcagcgccagcaccaagggc

SEQ ID NO: 35172 - RNA, 423 nt, Artificial Sequence
  derived and/or modified sequence opt4 from anti-HIV_Chain
aacggcggcagccugagacugagcugcagagugagcggcuucggcuuccaccuguacgagaugaacugggugagacaggcccccggcaagggccuggaguggaucagcagcaucagcggcagcggcgagagcacccacuacagcgacagcaucaccggcagauucagcaugagcagagacgaggccaaggacagccuguaccugcagaugaacaaccugagaguggaggacaccgccguguacuacugcaccagaggcuucagcaugggcgacggcaccggcuucagcuucgacaccuggggcagaggcaccauggugaccgugagcagcggccuggacaccgugagccuggccagcaccaagggccccagcguguucccccuggcccccugcagcagaagcaccagcgacgccagacugagc

SEQ ID NO: 35173 - RNA, 423 nt, Artificial Sequence
  derived and/or modified sequence opt4 from anti-HIV_Chain
caggugcagcuggugcagagcggcgccgaggugaagaagcccggcagcagcgugaaggugagcugcaaggccagcggcggcaccuucagcaccuacgccaucagcugggugagacaggcccccggccagggccuggaguggaugggcggcaucauccccagcuucagcaugagcaacuacgcccaggacuuccagggcagacugaccaucaccgccgacgagagcaccagcagcguguacauggagcugaacagccugagaagcgaggacaccgccguguacuacugcgccagagacuuccccagauuccacagacuggugggcaacuacgacuucuggagaggcacccuggacagauucagcuacauggaccuguggggcagaggcaccgccgugaccgugagcagcgccagcaccaagggc

SEQ ID NO: 35174 - RNA, 423 nt, Artificial Sequence
  derived and/or modified sequence opt4 from anti-HIV_Chain
cuggugcagcugguggagagcggcggcggcguggugcagcccggcagaagccugagacugagcugcgccgccagcggcuucaccuucagcaccuacgccaugcacugggugagacaggcccccggcaagggccuggaguggguggccgugaucagcuacgacggcagcaacaaguucuacgccgacagcgugaagggcagauucaccaucagcagagacaacagcaagaacacccuguaccugcagaugaacagccugagagccgaggacaccgccguguacuacugcgccagacccaaguuccugcccggcgccgacaucgugguggugguggccgccacccccuucgacuacuggggccagggcaaccccggccacagacugcugagcuuccaccagggccccaucggccugccccccggc

SEQ ID NO: 35175 - RNA, 423 nt, Artificial Sequence
  derived and/or modified sequence opt4 from anti-HIV_HeavyChain
auggaguggagcggcguguucaucuuccugcugagcgugaccgccggcgugcacagcgaggugcagcugguggagagcggcggcggccuggugaagcccggcggcagccugagacugagcugcgccgccagcggcuacaccuucagcaacuacuggaucggcugggugagacaggcccccggcaagggccuggaguggaucggcgacaucuaccccggcggcaacuacaucagaaacaacgagaaguucaaggacaagaccacccugagcgccgacaccagcaagaacaccgccuaccugcagaugaacagccugaagaccgaggacaccgccguguacuacugcggcagcagcuucggcagcaacuacguguucgccugguucaccuacuggggccagggcacccuggugaccgugagcagc

SEQ ID NO: 35176 - RNA, 423 nt, Artificial Sequence
  derived and/or modified sequence opt4 from anti-HIV_HeavyChain
auggaguggagcggcguguucaucuuccugcugagcgugaccgccggcgugcacagccaggugcagcuggugcagagcggccccgacgugaagaagcccggcaccagcaugaagaugagcugcaagaccagcggcuacaccuucagcaacuacuggaucggcugggugagacaggcccccggccagggccuggaguggaucggcgacaucuaccccggcggcaacuacaucagaaacaacgagaaguucaaggacaagaccacccugaccgccgacaccagcaccagcaccgccuacaugcagcugggcagccugagaagcgaggacaccgccguguacuacugcggcagcagcuucggcagcaacuacguguucgccugguucaccuacuggggccagggcacccuggugaccgugagcagc

SEQ ID NO: 35177 - RNA, 429 nt, Artificial Sequence
  derived and/or modified sequence opt4 from anti-HIV_Chain
cagguguucgugcagcuggugcagagcggcggcggccuggugcagcccggcggcagcgugagacugagcugcaccgccagcggcuuccuguucagcaccuacagcaugaacugggugagacaggcccccggcaagggccuggagugggugagcagcaucagcaccaccagcaacuacaucuacuacgccgacagcgugaagggcagauucaccaucagcagaagcaacggccagggcagccuguaccugcagcugaacagccugagaguggaggacaccgccguguacuacugcgccagagacaccaaggugggcgcccccagacaggacugcuacgccauggaccuguggggccagagagaccacggccacagacugcugagcuuccaccagggccccaucggccugccccccggcgcccugcugcag

SEQ ID NO: 35178 - RNA, 432 nt, Artificial Sequence
  derived and/or modified sequence opt4 from anti-HIV_Chain
aucauccuguuccugguggccaccgccaccggcgugcacagcgacauccagaugacccagagccccagcagccugagcgccagcgugggcgacagagugaccaucaccugcagagccagccagagcaucgacagauaccugaacugguaccagcacaagcccggcaaggcccccaagcugcugaucuacgccgccagcaaccugcacaccgacgugcccagcagauucagcggcagcggcgccggcaccuacuucacccugaccaucaccagccugcagcccgaggacuucgccaccuacuacugccagcagagccacagccccagcuucggccaggagagcuacagcaucgccuucggccagggcaccagacuggagaucaagagaaccguggccgcccccagcguguucaucuucccccccagcgacgag

SEQ ID NO: 35179 - RNA, 432 nt, Artificial Sequence
  derived and/or modified sequence opt4 from anti-HIV_Chain
cugcagcagcugcaggugcccagacugagcauguggagaguguucaagguggccgccgccaccggcgcccagacccugaccguggaggagcccggcagcagcgugaaggugagcugcaaggccagcggcggcagcagcaccgccuacggcuacagcugggugagacaggcccccggccagggcuucgaguggaugggcagaaucauccccuucuacggcaucaucaccuacgcccccaaguuccagggcagagugaccaucaccgccgacagaagcaccagcaccguguacauggagcugaccagccugaccuucgccgacaccgcccuguucuucugcgccagagacuucggcgaccccagaaacggcuacuacuucgacagcugggaccagggccuguggcugaccgugagcagcgccagcaccaagggc

SEQ ID NO: 35180 - RNA, 432 nt, Artificial Sequence
  derived and/or modified sequence opt4 from anti-HIV_Chain
caggugagacuggagcagagcggcguggccaugagaaagcccggcgccagcgugacccugagcugccaggccagcggcuacaacuucgugaaguacaucauccacugggugagacagaagcccggccugggcuucgagugggugggcaugaucgaccccuacagaggcagacccuggagcgcccacaaguuccagggcagacugagccugagcagagacaccagcauggagauccuguacaugacccugaccagccugaagagcgacgacaccgccaccuacuucugcgccagagccgaggccgccagcgacauccacagcagacccaucauccugaccggccccggcgaguacggccuggaccuggagcacauggacuggaccuggagaauccugugccugcuggccguggcccccggcugccacagccag

SEQ ID NO: 35181 - RNA, 435 nt, Artificial Sequence
  derived and/or modified sequence opt4 from anti-HIV_Chain
auguuccuguuccugguggccggcgccaccggcgugcagagccagguguaccuggugcccuucggccccgaggugaagaagcccggcagcagcgugaaggugagcugcaaggccagcggcgacagcuucaccagcagcgugaucaccugggugagacaggcccccggccagggccccgaguggaugggcagagugauccccgugcugggcguggccgccuacgcccagaaguucuacggcagagugaccaucaccgccgacaccagcagcaacaccgccuacauggaggugaacagccugagauucgaggacaccgccguguacuacugcgccagagagaccggcagaggcggcaaccuggcccugagacaguacuucuucgacagcuggggccagggcacccuggugaccgugagcagccccagcaccaagggc

SEQ ID NO: 35182 - RNA, 438 nt, Artificial Sequence
  derived and/or modified sequence opt4 from anti-HIV_Chain
caggugcagcugcaggagagcggccccggccuggugaagcccagcggcacccugagccugaccugcgccgugagcggcgccagcaucagcagcagaaacugguggaccugggugagacagccccccggcaagggccuggaguggaucggcgagaucuacgagagcggcgccaccaacuacaaccccagccugaagagcagagugaccaucagcguggacaagagcaagaaccaguucagccugagacugaccagcgugaccgccgccgacaccgccguguacuucugcgccagacugaugaccuucggcggccugaucggcacccuggacuacuggggccagggcacccuggugaccgugcugcagcccccccccagagcccacagauaccaccccagaaaccugcugcaggagcaccugugcgccagagugaugccc

SEQ ID NO: 35183 - RNA, 444 nt, Artificial Sequence
  derived and/or modified sequence opt4 from anti-HIV_HeavyChain
auggaguggagcggcguguucaucuuccugcugagcgugaccgccggcgugcacagcgaggugcagcugguggagagcggcggcggccuggugaagcccggcggcagccugagacugagcugcgccgccagcggcuacaccuucagcaacuacuggaucggcugggugagacaggcccccggcaagggccuggaguggaucggcgacaucuaccccggcggcaacuacaucagaaacaacgagaaguucaaggacaagaccacccugagcgccgacaccagcaagaacaccgccuaccugcagaugaacagccugaagaccgaggacaccgccguguacuacugcggcagcagcuucggcagcaacuacguguucgccugguucaccuacuggggccagggcacccuggugaccgugagcagcggcgagagccugaagccccug

SEQ ID NO: 35184 - RNA, 444 nt, Artificial Sequence
  derived and/or modified sequence opt4 from anti-HIV_HeavyChain
auggaguggagcggcguguucaucuuccugcugagcgugaccgccggcgugcacagccaggugcagcuggugcagagcggccccgacgugaagaagcccggcaccagcaugaagaugagcugcaagaccagcggcuacaccuucagcaacuacuggaucggcugggugagacaggcccccggccagggccuggaguggaucggcgacaucuaccccggcggcaacuacaucagaaacaacgagaaguucaaggacaagaccacccugaccgccgacaccagcaccagcaccgccuacaugcagcugggcagccugagaagcgaggacaccgccguguacuacugcggcagcagcuucggcagcaacuacguguucgccugguucaccuacuggggccagggcacccuggugaccgugagcagcggcgagagccugaagccccug

SEQ ID NO: 35185 - RNA, 447 nt, Artificial Sequence
  derived and/or modified sequence opt4 from anti-HIV_Chain
caggccagacuggaccaguggggcaccggccugcugaagcccagcgagacccugagccugaagugcgccguguucggcgugcuguucaccgacuacaacuggaccugggugagacagagccccggcaagggccuggaguggaucggccaccuggaccacagaggcggcggcaacuacaaccccagccuggagagcagagugaccaucagccuggacuacagcaaggcccaguucagccugcaccugaagagcgugaccguggccgacaccgcccuguacuacugcgccggcgccgugaagggcuucugguucgacgagguguacaacugguucggccccggcgugagagagcccuggcugcccagcccccagcccccccccagagcccacagaagcagccccuggcaccccccccccagagccccccuggugaccgccaccgugccc

SEQ ID NO: 35186 - RNA, 447 nt, Artificial Sequence
  derived and/or modified sequence opt4 from anti-HIV_Chain
caggccagacuggaccaguggggcaccggccugcugaagcccagcgagacccugagccugaagugcgccguguucggcgugcuguucaccgacuacaacuggaccugggugagacagagccccggcaagggccuggaguggaucggccaccuggaccacagaggcggcggcaacuacaaccccagccuggagagcagagugaccaucagccuggacuacagcaaggcccaguucagccugcaccugaagagcgugaccguggccgacaccgcccuguacuacugcgccggcgccgugaagggccugugguucgacgagaccuacaccugguucggccccuggagccagggcaccagagugaccguggccagcgccagcaccaagggccccagcguguucccccuggcccccagcagcaagagcaccagcggcaccagagaccugagc

SEQ ID NO: 35187 - RNA, 447 nt, Artificial Sequence
  derived and/or modified sequence opt4 from anti-HIV_Chain
gccgccagacuggaccaguggggcaccggccuggugaagcccagcgagacccugagccugaagugcgccguguucggcguggacuuccccgacuacaccuggaccugggccagacaggcccccggcaagggccuggaguggaucggccacagagaccacagaggcggcagcagcuacaaccccagccugagcggcagagccaccaucagccuggacaccagcaaggcccaguucagccugcacaucaagagcgugaccguggccgacaccgccaccuacuacugcgccggcgccguggccggccugugguucgaggacgccuacaacugguucggccccuggagccagggcacccuggugaccguggccgccgccagcaccaagggccccagcguguucccccuggcccccagcagcaagagcaccagcggccacgccagcgugcug

SEQ ID NO: 35188 - RNA, 450 nt, Artificial Sequence
  derived and/or modified sequence opt4 from anti-HIV_Chain
cuggcccagcuggagcagagcggcggcggcguggugaagcccggcggcagccugagacugcccugcgccgccagcggcuucaccuucaucgacuacuacauggccuggaucagacuggcccccggcaagggccuggaguggcugagcuacaucagcaagaacggcgacuacaccaaguacagcgagagccugaagggcagauucaccaucagcagagacaacgccaagaaccuggugauccugcagcugaacagacugagagccgacgacaccgccaucuacuucugcgccagagccgacggccugaccuacuucggcgagcugcugcaguacaucuucgaccuguggggccagggcgccagagugaucgugagcagcgccagcaccaagggccccagcguguucccccuggcccccagcagcaagagcaccagcggccacgccagcgug

SEQ ID NO: 35189 - RNA, 459 nt, Artificial Sequence
  derived and/or modified sequence opt4 from anti-HIV_Chain
caggugcagcuggugcagagcggcgccgaggugaagaagcccggcgccagcgugaaggugagcugcaaggugagcggcuacacccugaccgagcugagcauccacugggugagacaggcccccggcaagggccuggaguggaugggcggcuucgacagcgaggacggcgaggccaucuacaagcagaacuuccagggcagagugaccaugaccgaggacaccagcaccgacaccgccuacauggagcugagcagacugagaagcgaggacaccgccguguacuacugcgccaccgccgacagauucaagguggcccaggacgagggccuguucgugaucuucgacuacuggggccagggcaaccccggccacagacugcugagccugcaccagggccccaucggccugccccccggcacccugccccccaaggccaccagcggccacgccgccagaaga

SEQ ID NO: 35190 - RNA, 462 nt, Artificial Sequence
  derived and/or modified sequence opt4 from anti-HIV_Chain
cuggugcagcuggugcagagcggcgccgaggugaagaagcccggcgccagcgugaaggugagcugcaaggugagcggcuacagccugaccgagcugagcauccacugggugagacaggcccccggcaagggccuggaguggaugggcggcuucgacagcgaggacggcgaggccaucuacaagcagaacuuccagggcagagugaccaugaccgaggacaccagcaccgacaccgccuacauggagcugagcagacugagaagcgaggacaccgccguguacuacugcgccaccgccgaccccuucaagguggcccaggacgagggccuguucgugaucuucgacuacuggggccagggcaccaccggccacagacugcugagccugcaccagggcccccacagacuguacagccugggcacccugcugagcagagcccccaucgugcagacccacauggcc

SEQ ID NO: 35191 - RNA, 471 nt, Artificial Sequence
  derived and/or modified sequence opt4 from anti-HIV_Chain
cagauccaccuggugcagagcggcaccgacgugaagaagcccggcagcagcgugaccgugagcugcaaggccuacggcgugaacaccuucggccuguacgccgugaacugggugagacaggcccccggccagagccuggaguacaucggccagaucuggagauggaagagcagcgccagccaccacuucagaggcagagugcugaucagcgccguggaccugaccggcagcagcccccccaucagcagccuggagaucaagaaccugaccagcgacgacaccgccguguacuucugcaccaccaccagcaccuacgaccaguggagcggccugcaccacgacggcgugauggccuucagcagcagaggccagggcacccugaucagcgugagcgccgccagcaccaagggccccagcguguucccccuggcccccagcagcaagagcaccuacggccuggcccacgugcug

SEQ ID NO: 35192 - RNA, 477 nt, Artificial Sequence
  derived and/or modified sequence opt4 from anti-HIV_Chain
cagcaccagcuggugcccugcguggccgaggugagaaagcccggcgccagcgugaaggugagcugcaaggugagcggcuacacccugaccgagaucagcaugcacugggugagacaggcccccggcaagggccuggaguggaugggcggcuucgacagagaggacggcgagaccaucuacgcccagaaguuccagggcagagugaccaugaccgaggacaccagcaccgacaccgccuacauggagcugagcagccugagaagcgaggacaccgccguguacuacugcgccaccaccuaccuggccguggugcccgacggcuucgacggcuacagcagcagcugguacugguucgaccccuggggccagggcacccuggugaccgugagcagcgccagcaugcagggccccaugcugcugagccccaccggcacccugcugcccagagccccccuggugcagaccagacccggcccc

SEQ ID NO: 35193 - RNA, 642 nt, Artificial Sequence
  derived and/or modified sequence opt4 from anti-HIV_LightChain
gacaucgugaucacccagagcaccaaguucaugagcaccagcgugggcgacagagugagcaucaccugcaaggccagccaggacgugagcaccgccguggccugguaccagcagaagcccggccagagccccaagcugcugaucuacugggccagcaccagacacaccggcgugcccgacagauucaccggcagcggcagcggcaccgacuacacccugaccaucagcagagugcaggccgaggaccuggcccuguacuacugccagcagcacuacaccacccccuggaccuucggcggcggcaccaagcuggagaucaagagaaccguggccgcccccagcuucgugaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35194 - RNA, 651 nt, Artificial Sequence
  derived and/or modified sequence opt4 from anti-HIV_Chain
cagagcgugcugacccagccccccagcgugagcgccgcccccggccagaaggugaccaucagcugcagcggcagcagcagcaacaucggcaacaacuacgugcugugguaccagcaguuccccggcaccgcccccaagcugcugaucuacggcaacaacaagagacccagcggcauccccgacagauucagcggcagcaagagcggcaccagcgccacccugggcaucaccggccugcagaccggcgacgaggccgacuacuucugcgccaccugggacagcggccugagcgccgacuggguguucggcggcggcaccaagcugaccgugcugagccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35195 - RNA, 657 nt, Artificial Sequence
  derived and/or modified sequence opt4 from anti-HIV_Chain
gacaucgugaugacccagagccccgacagccuggccgugagccugggcgagagagugaccaugaacugcaagagcagccagagccugcuguacagcaccaaccagaagaacuaccuggccugguaccagcagaagcccggccagagccccaagcugcugaucuacugggccaacagcaccgagagcggcgugcccgacagauucagcggcagcggcagcggcaccgacuucacccugaccaucagcagcgugcaggccgaggacguggccguguacuacugccagcaguacuacagcuacagaaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35196 - RNA, 753 nt, Artificial Sequence
  derived and/or modified sequence opt4 from anti-HIV_SingleChain
augcaggugcagcuggagcagagcggcgccgaggugaagaagcccggcgccagcgugaaggugagcugccaggccagcggcuacagauucagcaacuucaccgugcacugggugagacaggcccccggccagagauucgaguggaugggcuggaucaaccccuacaacggcaacaaggaguucagcgccaaguuccaggacagagugaccuucaccgccgacaccagcgccaacaccgccuacauggagcugagaagccugagaagcgccgacaccgccguguacuacugcgccagagugggcgaguggggcugggacgacagcccccaggacaacuacuacauggacguguggggcaagggcaccaccgugaucgugagcagcggcggcggcggcagcggcggcggcggcagcggcggcggcggcagcgacaucgagcugacccagagccccggcacccugagccugagccccggcgagagagccaccuucagcugcagaagcagccacagcaucagaagcagaagaguggccugguaccagcacaagcccggccaggcccccagacuggugauccacggcgugagcaacagagccagcggcaucagcgacagauucagcggcagcggcagcggcaccgacuucacccugaccaucaccagaguggagcccgaggacuucgcccuguacuacugccagguguacggcgccagcagcuacaccuucggccagggcaccaagcuggagagaaag

SEQ ID NO: 35197 - RNA, 1338 nt, Artificial Sequence
  derived and/or modified sequence opt4 from anti-HIV_LightChain
gaggugaagcuggaggagagcggcggcggccuggugcagcccggcggcagcagaaagcugagcugcgccgccagcggcuucaccuucagcagcuucggcaugcacugggugagacaggcccccgagaagggccuggaguggguggccuacaucagcagcggcagcagcacccugcacuacgccgacaccgugaagggcagauucaccaucagcagagacaaccccaagaacacccuguuccugcagaugaagcugcccagccugugcuacggccugcugggcagcagaaaccugagccacagacugcugagccagaacgacacccccaucugccugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35198 - RNA, 1380 nt, Artificial Sequence
  derived and/or modified sequence opt4 from anti-HIV_Chain
gaggugcagcugguggagagcggcggcggccuggugaagcccggcggcagccugagacugaccugcguggccagcggcuucaccuucagcgacguguggcugaacugggugagacaggcccccggcaagggccuggagugggugggcagaaucaagagcagaaccgacggcggcaccaccgacuacgccgccagcgugaagggcagauucaccaucagcagagacgacagcaagaacacccuguaccugcagaugaacagccugaagaccgaggacaccgccguguacagcugcaccaccgacggcuucaucaugaucagaggcgugagcgaggacuacuacuacuacuacauggacguguggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 35199 - RNA, 1413 nt, Artificial Sequence
  derived and/or modified sequence opt4 from anti-HIV_Chain
auggaguggagcggcguguucauguuccugcugagcgugaccgccggcgugcacagccaggugcagcugcagcagagcggccccgagguggugaagcccggcgccagcgugaagaugagcugcaaggccagcggcuacaccuucaccagcuacgugauccacugggugagacagaagcccggccagggccuggacuggaucggcuacaucaaccccuacaacgacggcaccgacuacgacgagaaguucaagggcaaggccacccugaccagcgacaccagcaccagcaccgccuacauggagcugagcagccugagaagcgaggacaccgccguguacuacugcgccagagagaaggacaacuacgccaccggcgccugguucgccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaguucgagggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgccagcaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35200 - RNA, 645 nt, Artificial Sequence
  derived and/or modified sequence opt4 from anti-influenza_Fab
aucgugcugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagcccgaggacuucgccguguacuacugccagcacuacagcaacuggccccccagacugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35201 - RNA, 681 nt, Artificial Sequence
  derived and/or modified sequence opt4 from anti-influenza_Fab
gugcagcugguggagagcggcggcggcguggugcagcccggcaagagccccagacugagcugcgccgccagcggccccaccuucagcagcuacgccgugcacugggugagacaggcccccggcaagggccuggagugggugacccugaucagcuacgacggcgccaaccaguacuacgccgacagcgugaagggcagauucaccaucagcagagacaacagcaagaacaccguguaccugcagaugaacagccugagacccgaggacaccgccguguacuacugcgccgugcccggccccguguucggcaucuucccccccuggagcuacuucgacaacuggggccagggcauccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 35202 - RNA, 1515 nt, Artificial Sequence
  derived and/or modified sequence opt4 from anti-influenza_Fab
gccggcagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugagccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcagcggcagacuggugcccaga

SEQ ID NO: 35203 - RNA, 657 nt, Artificial Sequence
  derived and/or modified sequence opt4 from anti-influenza_Fab
caggugcagcuggugcagagcggcggcggcguggugcagcccggcagaagccugagacugagcugcgccgccagcgaguucaccuucagaauguacgccacccacugggugagacaggcccccggcaagggccuggaguggguggcccugaucagcuacgacggcagcaacaaguacuacgccgacagcgugaagggcagauucaccaucagcagagacaacagcaugaacaccguguaccugcagaugaacacccugagacccgaggacaccgccguguacuacugcgccagagaccugggcggcuacuucaucagaggcaucauggacguguggggccagggcacccuggugaccgugagcagcgccagcaccaagggccccagcguguucccccuggcccccagcagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaag

SEQ ID NO: 35204 - RNA, 642 nt, Artificial Sequence
  derived and/or modified sequence opt4 from anti-influenza_Fab
gagcugcagaugacccagagccccagcagcgugagcgccagcgugggcgacagagugaccaucaccugcagagccagccagggcaucagcagcuggcuggccugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcaggccaacagcuucccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35205 - RNA, 993 nt, Artificial Sequence
  derived and/or modified sequence opt4 from anti-influenza_Fab
gccgaccccggcgacaccaucugcaucggcuaccacgccaacaacagcaccgacaccguggacaccgugcuggagaagaacgugaccgugacccacagcgugaaccugcuggaggacagccacaacggcaagcugugcaagcugaagggcaucgccccccugcagcugggcaagugcaacaucgccggcuggcugcugggcaaccccgagugcgaccugcugcugaccgccagcagcuggagcuacaucguggagaccagcaacagcgagaacggcaccugcuaccccggcgacuucaucgacuacgaggagcugagagagcagcugagcagcgugagcagcuucgagaaguucgagaucuuccccaagaccagcagcuggcccaaccacgagaccaccaagggcgugaccgccgccugcagcuacgccggcgccagcagcuucuacagaaaccugcuguggcugaccaagaagggcagcagcuaccccaagcugagcaagagcuacgugaacaacaagggcaaggaggugcuggugcuguggggcgugcaccacccccccaccggcaccgaccagcagagccuguaccagaacgccgacgccuacgugagcgugggcagcagcaaguacaacagaagauucacccccgagaucgccgccagacccaaggugagagaccaggccggcagaaugaacuacuacuggacccugcuggagcccggcgacaccaucaccuucgaggccaccggcaaccugaucgcccccugguacgccuucgcccugaacagaggcagcggcagcggcaucaucaccagcgacgcccccgugcacgacugcaacaccaagugccagaccccccacggcgccaucaacagcagccugcccuuccagaacauccaccccgugaccaucggcgagugccccaaguacgugagaagcaccaagcugagaauggccaccggccugagaaacauccccagcauccagagcaga

SEQ ID NO: 35206 - RNA, 537 nt, Artificial Sequence
  derived and/or modified sequence opt4 from anti-influenza_Fab
ggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaaccuggagagaagaaucgagaaccugaacaagaagguggacgacggcuuccuggacaucuggaccuacaacgccgagcugcuggugcugcuggagaacgagagaacccuggacuuccacgacagcaacgugagaaaccuguacgagaaggugaagagccagcugaagaacaacgccaaggagaucggcaacggcugcuucgaguucuaccacaagugcgacgacgccugcauggagagcgugagaaacggcaccuacgacuaccccaaguacagcgaggagagcaagcugaacagagaggagaucgacggcgugagcggcaga

SEQ ID NO: 35207 - RNA, 642 nt, Artificial Sequence
  derived and/or modified sequence opt4 from anti-influenza_Apo
cagagcgugcugacccagccccccagcgugagcguggcccccggccagaccgccagaaucaccugcggcggcaacgacaucggcagaaagagcgugcacuggaaccagcagaagcccggccaggcccccgugcugguggugugcuacgacagcgacagacccagcggcauccccgagagauucagcggcagcaacagcggcaacaccgccacccugaccaucagcagaguggaggccggcgacgaggccgacuacuacugccaggugugggacagcagcagcgaccacgugaucuucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35208 - RNA, 687 nt, Artificial Sequence
  derived and/or modified sequence opt4 from anti-influenza_Apo
gaggugcagcuggugcagagcggcgccgaggugaagaagcccggcgccagcgugaaggugagcugcaaggccagcggcuacaccuucaccgacuaccacaucaacugggugagacaggcccccggccagggccuggaguggaugggcuggauccaccccaacagcggcgacaccaacuacgcccagaaguuccagggcugggugaccaugaccagagacaccgccaucagcaccgccuacauggaggugaacggccugaagagcgacgacaccgccguguacuacugcgccagaggcggccuggagcccagaagcguggacuacuacuacuacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugc

SEQ ID NO: 35209 - RNA, 333 nt, Artificial Sequence
  derived and/or modified sequence opt4 from anti-influenza-A_kappa_LightChain_V-Region
gacaucgugaugacccagagccccgacagccuggccgugagccugggcgccagagccaccaucaacugcaagagcagccagagcgugaccuucaacuacaagaacuaccuggccugguaccagcagaagcccggccagccccccaaggugcugaucuacugggccagcgccagagagagcggcgugcccgacagauucagcggcagcggcagcggcaccgacuucacccugaccaucagcagccugcaggccgaggacguggccguguacuacugccagcagcacuacagaaccccccccaccuucggccagggcaccaagguggagaucaag

SEQ ID NO: 35210 - RNA, 333 nt, Artificial Sequence
  derived and/or modified sequence opt4 from anti-influenza-A_kappa_LightChain_V-Region
gacaucgugaugacccagagccccgacagccuggccgugagccugggcgagagagccaccaucaacugcaagagcagccagagcgugagcagcaacaacaagaacuaccuggccugguaccagcagaagcccggccagccccccaaggugcugaucuacugggccagcgccagagagagcggcgugcccgacagauucagcggcagcggcagcggcaccgacuucacccugaccaucagcagccugcaggccgaggacguggccguguacuacugccagcagcacuacagaaccccccccaccuucggccagggcaccaagguggagaucaag

SEQ ID NO: 35211 - RNA, 333 nt, Artificial Sequence
  derived and/or modified sequence opt4 from anti-influenza-A_kappa_LightChain_V-Region
gacaucgugaugacccagagccccgacagccuggccgugagccugggcgagagagccaccaucaacugcagaagcagccagagcgugagcagcaacaacaagaacuuccuggccugguaccaggagaagcccggccagccccccaaggugcugaucuacugggccagcgccagagagagcggcgugcccgacagauucagcggcagcggcagcggcaccgacuucacccugaccaucagcggccugcaggccgaggacguggccguguacuacugccagcagcacuacagaaccccccccaccuucggccagggcaccaagguggagaucaag

SEQ ID NO: 35212 - RNA, 333 nt, Artificial Sequence
  derived and/or modified sequence opt4 from anti-influenza-A_kappa_LightChain_V-Region
gacaucgugaugacccagagccccgacagccuggccgugagccugggcgagagagccaccaucaacugcaagagcagccagagcgugaccuucaacuacaagaacuaccuggccugguaccagcagaagcccggccagccccccaagcugcugaucuacugggccagcaccagagagagcggcgugcccgacagauucagcggcagcggcagcggcaccgacuucacccugaccaucagcagccugcaggccgaggacguggccguguacuacugccagcagcacuacagaaccccccccaccuucggccagggcaccaagguggagaucaag

SEQ ID NO: 35213 - RNA, 339 nt, Artificial Sequence
  derived and/or modified sequence opt4 from anti-influenza-A_kappa_LightChain_V-Region
gacaucgugaugacccagagccccgacagccuggccgugagccugggcgagagagccaccaucaacugcaagagcagccagagcgugcuguacagcagcaacaacaagaacuaccuggccugguaccagcagaagcccggccagccccccaagcugcugaucuacugggccagcaccagagagagcggcgugcccgacagauucagcggcagcggcagcggcaccgacuucacccugaccaucagcagccugcaggccgaggacguggccguguacuacugccagcaguacuacagcaccccccccaccuucggccagggcaccaagguggagaucaag

SEQ ID NO: 35214 - RNA, 333 nt, Artificial Sequence
  derived and/or modified sequence opt4 from anti-influenza-A_kappa_LightChain_V-Region
gacauccagaugacccagagccccgacagccuggccgugagccugggcgccagagccaccaucaacugcaagagcagccagagcgugaccuucaacuacaagaacuaccuggccugguaccagcagaagcccggccagccccccaaggugcugaucuacugggccagcgccagagagagcggcgugcccgacagauucagcggcagcggcagcggcaccgacuucacccugaccaucagcagccugcaggccgaggacguggccguguacuacugccagcagcacuacagaaccccccccaccuucggccagggcaccaagguggagaucaag

SEQ ID NO: 35215 - RNA, 387 nt, Artificial Sequence
  derived and/or modified sequence opt4 from anti-influenza-A_HeavyChain_V-Region
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccaaggacagccagcugagaagccugcuguacuucgacuggcugagccagggcuacuucgacuacuggggccagggcacccuggugaccgugagcagc

SEQ ID NO: 35216 - RNA, 387 nt, Artificial Sequence
  derived and/or modified sequence opt4 from anti-influenza-A_HeavyChain_V-Region
caggugcagcuggugcagagcggcggcggcguggugcagcccggcagaagccugagacugagcugcguggccagcggcuucaccuucagcaccuacgccaugcacugggugagacaggcccccggcagaggccuggaguggguggccgugaucagcuacgacggcaacuacaaguacuacgccgacagcgugaagggcagauucagcaucagcagagacaacagcaacaacacccugcaccuggagaugaacacccugagaaccgaggacaccgcccuguacuacugcgccaaggacagccagcugagaagccugcuguacuucgaguggcugagccagggcuacuucgaccccuggggccagggcacccuggugaccgugagcagc

SEQ ID NO: 35217 - RNA, 387 nt, Artificial Sequence
  derived and/or modified sequence opt4 from anti-influenza-A_HeavyChain_V-Region
caggugcagcuggugcagagcggcggcggcguggugcagcccggcagaagccugagacugagcugcgccgccagcggcuucaccuucagcaccuacggcaugcacugggugagacaggcccccggcaagggccuggaguggguggccgugaucagcuacgacggcaacuacaaguacuacgccgacagcgugaagggcagauucaccaucagcagagacaacagcaagaacacccuguaccuggagaugaacagccugagaaccgaggacaccgcccuguacuacugcgccaaggacagccagcugagaagccugcuguacuucgacuggcugagccagggcuacuucgaccacuggggccagggcacccuggugaccgugagcagc

SEQ ID NO: 35218 - RNA, 387 nt, Artificial Sequence
  derived and/or modified sequence opt4 from anti-influenza-A_HeavyChain_V-Region
caggugcagcuggugcagagcggcggcggcguggugccccccggcagaagccugagacugagcugcgccgccagcggcuucaccuucagcaccuacggcaugcacugggugagacaggcccccggcaagggccuggaguggguggccgugaucagcuacgacggcaacuacaaguacuacgccgacagcgugagaggcagauucaccaucagcagagacaacagcaagaacacccugaaccuggacaugaacagccugagaaccgaggacaccgcccuguacuacugcgccaaggacagccagcugagaagccugcuguacuucgacuggcugagccagggcuacuucgaccacuggggccagggcacccuggugaccgugagcagc

SEQ ID NO: 35219 - RNA, 387 nt, Artificial Sequence
  derived and/or modified sequence opt4 from anti-influenza-A_HeavyChain_V-Region
caggugcagcugguggagagcggcggcggcguggugcagcccggcagaagccugagacugagcugcgccgccagcggcuucaccuucagcaccuacgccaugcacugggugagacaggcccccggcaagggccuggaguggguggccgugaucagcuacgacgccaacuacaaguacuacgccgacagcgugaagggcagauucaccaucagcagagacaacagcaagaacacccuguaccugcagaugaacagccugagagccgaggacaccgccguguacuacugcgccaaggacagccagcugagaagccugcuguacuucgaguggcugagccagggcuacuucgacuacuggggccagggcacccuggugaccgugagcagc

SEQ ID NO: 35220 - RNA, 387 nt, Artificial Sequence
  derived and/or modified sequence opt4 from anti-influenza-A_HeavyChain_V-Region
caggugcagcugguggagagcggcggcggcguggugcagcccggcagaagccugagacugagcugcgccgccagcggcuucaccuucagcaccuacgccaugcacugggugagacaggcccccggcaagggccuggaguggguggccgugaucagcuacgacggcaacuacaaguacuacgccgacagcgugaagggcagauucaccaucagcagagacaacagcaagaacacccuguaccugcagaugaacagccugagagccgaggacaccgccguguacuacugcgccaaggacagccagcugagaagccugcuguacuucgaguggcugagccagggcuacuucgaccccuggggccagggcacccuggugaccgugagcagc

SEQ ID NO: 35221 - RNA, 387 nt, Artificial Sequence
  derived and/or modified sequence opt4 from anti-influenza-A_HeavyChain_V-Region
caggugcagcuggugcagagcggcggcggcguggugcagcccggcagaagccugagacugagcugcguggccagcggcuucaccuucagcaccuacgccaugcacugggugagacaggcccccggcagaggccuggaguggguggccgugaucagcuacgacggcaacuacaaguacuacgccgacagcgugaagggcagauucagcaucagcagagacaacagcaacaacacccugcaccuggagaugaacacccugagaaccgaggacaccgcccuguacuacugcgccaaggacagccagcugagaagccugcuguacuucgaguggcugagccagggcuacuucgaccccuggggccagggcacccuggugaccgugaccagc

SEQ ID NO: 35222 - RNA, 330 nt, Artificial Sequence
  derived and/or modified sequence opt4 from anti-influenza-A_LightChain_V-Region
aacuucaugcugacccagccccccagcgccagcggcacccccggccagagagugaccaucagcugcagcggcagcagcagcaacaucggcggcaacaccgugcacugguuccagcagcugcccggcaccgcccccaagcugcugaucuacaccaacagccugagacccagcggcgugcccgacagauucagcggcagcaagagcggcaccagcgccagccuggccaucagcggccugcagagcgaggacgaggccgacuacuacugcgccgccugggacgacagccugaacggccagguguucggcggcggcaccaagcugaccgugcug

SEQ ID NO: 35223 - RNA, 390 nt, Artificial Sequence
  derived and/or modified sequence opt4 from anti-influenza-A_HeavyChain_V-Region
caggugcagcugcuggagagcggcggcggcguggugcagcccggcagaagccugagacugagcugcgccgccagcggcuucaccuucagcaacuacggcaugcacugggugagacaggcccccggcaagggccuggaguggguggccaucaucagcuucgacggcagcaagaaguacuacgccaacagcgugaagggcagaagcaccaucagcagagacaacagcaagaacacccugagccugcagaugaacagccugggccccgaggacaccgcccuguacuacugcgccaagcugcccagccccuacuacuucgacagcagauucguguggguggccgccagcgccuuccacuucuggggccagggcauccuggugaccgugagcagc

SEQ ID NO: 35224 - RNA, 132 nt, Artificial Sequence
  derived and/or modified sequence opt4 from anti-influenza_Chain
aacgugcccgaguggagcuacaucguggagaaggccaaccccgccaacgaccugugcuaccccggcaacuucaacgacuacgaggagcugaagcaccugcugagcagaaucaaccacuucgagaagauccag

SEQ ID NO: 35225 - RNA, 162 nt, Artificial Sequence
  derived and/or modified sequence opt4 from anti-influenza_Chain
agcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 35226 - RNA, 291 nt, Artificial Sequence
  derived and/or modified sequence opt4 from anti-influenza_Chain
augagccugcugaccgagguggagacccccaucagaaacgaguggggcugcagaugcaacggcagcagcgacccccuggccaucgccgccaacaucaucggcauccugcaccugauccuguggauccuggacagacuguucuucaagugcaucuacagaagauucaaguacggccugaagggcggccccagcaccgagggcgugcccaagagcaugagagaggaguacagaaaggagcagcagagcgccguggacgccgacgacggccacuucgugagcaucgagcuggag

SEQ ID NO: 35227 - RNA, 300 nt, Artificial Sequence
  derived and/or modified sequence opt4 from anti-influenza_Chain
augaacaacgccaccuucaacugcaccaacaucaaccccaucacccacaucagaggcagcaucaucaucaccaucugcgugagccugaucgugauccugaucguguucggcugcaucgccaagaucuucaucaacaagaacaacugcaccaacaacgugaucagagugcacaagagaaucaagugccccgacugcgagcccuucugcaacaagagagacgacaucagcacccccagagccggcguggacauccccagcuucauccugcccggccugaaccugagcgagggcacccccaac

SEQ ID NO: 35228 - RNA, 300 nt, Artificial Sequence
  derived and/or modified sequence opt4 from anti-influenza_Chain
gagcugacccagagccccagcagccugagcgccagcgugggcgacagcgugaccaucaccugcagaaccagcgagagaaucagcaccuaccugaacugguaccagcagaagcccggcaaggcccccagacugcuggugagcggcgccagcacccugcagggcggcgugcccagcagauucagcggcagcggcagcggcaccgccuucacccugaccaucaacagccugcagcccgaggacuucgccaccuacuacugccagcagagcuacagcaccccccugaccuucggcggcggcacc

SEQ ID NO: 35229 - RNA, 300 nt, Artificial Sequence
  derived and/or modified sequence opt4 from anti-influenza_Chain
augacccagagccccagcagcaugagcgugagccugggcgacaccgugagcaucaccugccacgccagccaggacaucagcggccacaucggcuggcugcagcagaagcccggcaagagcuucaagggccugaucuaccacggcaccaaccuggaggacggcgugcccagcagauucagcggcagcggcagcggcgccgacuucagccugaccaucagcagccuggagagcgaggacuucgccgacuacuacugcgugcaguacgugcaguuccccuggaccuucggcggcggcaccaag

SEQ ID NO: 35230 - RNA, 306 nt, Artificial Sequence
  derived and/or modified sequence opt4 from anti-influenza_Chain
gacauccaggugacccagagccccagcagccugagcgccagcgugggcgacagagugaccaucagcugcagagcccagagccugagcagcuaccugcacugguaccagcagaagcccggccagccccccaagcugcugaucuacgccgccaccacccugcagagcggcgugcccagcagauucagcggcagcggcagcggcaccgacuucacccugaccaucagcaccuuccaggccgaggacguggccaccuacuacugccagcagagcagaaccuucggccagggcaccaagguggagaucaag

SEQ ID NO: 35231 - RNA, 306 nt, Artificial Sequence
  derived and/or modified sequence opt4 from anti-influenza_Chain
gacauccagaugacccagagccccagcagccugagcgccagcgugggcgacagagugaccaucagcugcagagcccagagccugagcagcuaccugcacugguaccagcagaagcccggccagccccccaagcugcugaucuacgccgccaccacccugcagagcggcgugcccagcagauucagcggcagcggcagcggcaccgacuucacccugaccaucagcaccuuccaggccgaggacguggccaccuacuacugccagcagagcagaaccuucggccagggcaccaagguggagaucaag

SEQ ID NO: 35232 - RNA, 309 nt, Artificial Sequence
  derived and/or modified sequence opt4 from anti-influenza_Chain
gacauccagaucacccagagccccagcagccugagcgccagcgugggcgacagagugaccaucaccugcagaaccagccagagccugagcagcuaccugcacugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcagagcagaaccuucggccagggcaccaagguggagaucaag

SEQ ID NO: 35233 - RNA, 309 nt, Artificial Sequence
  derived and/or modified sequence opt4 from anti-influenza_Chain
gacauccagaugacccagagccccagcagccugagcgccagcgugggcgacagagugaccaucaccugcagaaccagccagagccugagcagcuaccugcacugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcagagcagaaccuucggccagggcaccaagguggagaucaag

SEQ ID NO: 35234 - RNA, 309 nt, Artificial Sequence
  derived and/or modified sequence opt4 from anti-influenza_Chain
gacauccaggugacccagagccccagcagccugagcgccagcgugggcgacagagugaccaucagcugcagagccagccagagacugaacagcuaccugcacugguaccagcagacccccggccaggcccccaagcugcugaucuacgccaccagcacccugcagagcggcgugagccccagauucagcggcagcggcagcggcaccgacuucacccugaccaucagcagccugcagcccgaggacguggccaccuacuacugccagcugagcagaaccuucggccacggcaccaagguggagaucaag

SEQ ID NO: 35235 - RNA, 309 nt, Artificial Sequence
  derived and/or modified sequence opt4 from anti-influenza_Chain
gacauccagaugacccagagccccagcagccugagcgccagcgugggcgacagagugaccaucagcugcagagccagccagagacugaacagcuaccugcacugguaccagcagacccccggccaggcccccaagcugcugaucuacgccaccagcacccugcagagcggcgugagccccagauucagcggcagcggcagcggcaccgacuucacccugaccaucagcagccugcagcccgaggacguggccaccuacuacugccagcugagcagaaccuucggccacggcaccaagguggagaucaag

SEQ ID NO: 35236 - RNA, 309 nt, Artificial Sequence
  derived and/or modified sequence opt4 from anti-influenza_Chain
gacauccaggugacccagagccccagcagccugagcgccagcgugggcgacagaaucaccaucagcugcagaaccagccagagccugagaagcuaccugcacugguaccagcagaagcccggcaaggcccccaagcugcugaucuacgccagcagcacccugcagagcggcgugcccagcagauucagcggcagcggcagcggcaccgacuucacccugaccaucagcaaccugcagcccgaggacuucgccaccuacuacugccagcugagcagaaccuucggccagggcaccaagguggagaucaag

SEQ ID NO: 35237 - RNA, 309 nt, Artificial Sequence
  derived and/or modified sequence opt4 from anti-influenza_Chain
gacauccagaugacccagagccccagcagccugagcgccagcgugggcgacagaaucaccaucagcugcagaaccagccagagccugagaagcuaccugcacugguaccagcagaagcccggcaaggcccccaagcugcugaucuacgccagcagcacccugcagagcggcgugcccagcagauucagcggcagcggcagcggcaccgacuucacccugaccaucagcaaccugcagcccgaggacuucgccaccuacuacugccagcugagcagaaccuucggccagggcaccaagguggagaucaag

SEQ ID NO: 35238 - RNA, 309 nt, Artificial Sequence
  derived and/or modified sequence opt4 from anti-influenza_Chain
gacauccagaugacccagagccccagcagccugagcgccagcgugggcgacagagugaccaucaccugcagaaccagccagagccugagcagcuacacccacugguaccagcagaagcccggcaaggcccccaagcugcugaucuacgccgccagcagcagacugagcggcgugcccagcagauucagcggcagcggcagcggcaccgacuucacccugaccaucagcagccugcagcccgaggacuucgccaccuacuacugccagcagagcagaaccuucggccagggcaccaagguggagaucaag

SEQ ID NO: 35239 - RNA, 309 nt, Artificial Sequence
  derived and/or modified sequence opt4 from anti-influenza_Chain
gacauccagaugacccagagccccagcagccugagcgccagcgugggcgacagagugaccaucaccugcagaaccagccagagccugagcagcuacacccacugguaccagcagaagcccggcaaggcccccaagcugcugaucuacgccgccagcagcagaggcagcggcgugcccagcagauucagcggcagcggcagcggcaccgacuucacccugaccaucagcagccugcagcccgaggacuucgccaccuacuacugccagcagagcagaaccuucggccagggcaccaagguggagaucaag

SEQ ID NO: 35240 - RNA, 309 nt, Artificial Sequence
  derived and/or modified sequence opt4 from anti-influenza_Chain
gacauccagaugacccagagccccagcagccugagcgccagcgugggcgacagagugaccaucaccugcagaaccagccagagccugagcagcuacgaccacugguaccagcagaagcccggcaaggcccccaagcugcugaucuacgccgccagcagcagacugagcggcgugcccagcagauucagcggcagcggcagcggcaccgacuucacccugaccaucagcagccugcagcccgaggacuucgccaccuacuacugccagcagagcagaaccuucggccagggcaccaagguggagaucaag

SEQ ID NO: 35241 - RNA, 318 nt, Artificial Sequence
  derived and/or modified sequence opt4 from anti-influenza_Chain
gagaucgugaugacccagagccccgacacccugagcgugagccccggcgagagagccacccugagcugcagagccagccagagcgugaacagaagacuggccugguaccagcagaagcccggccaggcccccagacugcugauccacgacgccagcaccagagccaccggcauccccgccagauucagcggcagcggcagcggcaccgaguucacccugaccaucagcagccugcagagcgaggacuucgccguguacuacugccagcaguacgacaacuggcugagcuucggccagggcaccagacuggagaucaag

SEQ ID NO: 35242 - RNA, 318 nt, Artificial Sequence
  derived and/or modified sequence opt4 from anti-influenza_Chain
gacauccagcugacccagagccccagcagccugagcgccagcgugggcgacagagugaccaucaccugcagagccagccagggcauccugaacugccuggccugguaccagcagaagcccggcaaggugcccaaccugcugauguacgccgccagcacccugcagagcggcgugcccagcagauucagcggcagcggcuucggcaccgacuucacccugaccaucagcagccugcagcccgaggacguggccaccuacuacugccagaccuacggcggcgugagcaccuucggcggcggcaccaagguggagaucaga

SEQ ID NO: 35243 - RNA, 318 nt, Artificial Sequence
  derived and/or modified sequence opt4 from anti-influenza_Chain
agcuacgugcugacccagccccccagcgugagcguggcccccggccagaccgccagaaucagcugcggcggcagcaacaucggcggcaagagcgugcacugguaccagcagaagcccggccaggcccccgugcuggugguguacgacgacagcggcagacccagcggcauccccgagagauucagcggcagcaacagcggcgacaccgccacccugaccaucagcagaguggaggccggcgacgaggccgacuacuucugccaggugugggacaacuucggcggcguguucggcaccggcaccaaggugaccgugcug

SEQ ID NO: 35244 - RNA, 318 nt, Artificial Sequence
  derived and/or modified sequence opt4 from anti-influenza_Chain
gacauccagaugacccagagccccagcagccugagcgccagcgugggcgacagagugaccaucaccugcagaaccagccagagcaucagcagcuaccugaacugguaccagcagaagcccggcaaggcccccaagcugcugaucuacgccgccagcagccugcagagcggcgugcccagcagauucagcggcagcggcagcggcaccgacuucacccugaccaucagcggccugcagcccgaggacuucgccaccuacuacugccagcagagcuacagcaugcccgccuucggccagggcaccaagcuggagaucaag

SEQ ID NO: 35245 - RNA, 318 nt, Artificial Sequence
  derived and/or modified sequence opt4 from anti-influenza_Chain
gacauccagaugacccagagcccccugagcgugagcgugagcgugggcgacagagugaccaucgccugcagagccagccagagcaucgacaaguuccugaacugguaccagcagaagcccggcaaggcccccaagcugcugaucuacggcgccagcaaccugcacagcggcgcccccagcagauucagcgccagcggcagcggcaccgacuucacccugaccaucaccaacauccagaccgaggacuucgccaccuaccugugccagcagagcuucagcgugcccgccuucggcggcggcaccaagguggagaucaag

SEQ ID NO: 35246 - RNA, 318 nt, Artificial Sequence
  derived and/or modified sequence opt4 from anti-influenza_Chain
gacauccagaugacccagagccccagcagccugagcgccagcgugggcgacagagugaccaucaccugcagagccagccagagcaucagcaccuaccugaacugguaccagaagagacccggcaaggcccccaagcugcugguguacggcgccagcacccugcagagcggcgugcccagcagauucagcggcagcggcagcggcaccgacuucacccugaccaucgccagccugcagcccgaggacagcgccaccuacuacugccagcagaccuacagcaucccccuguucggccagggcaccagacuggagaucaag

SEQ ID NO: 35247 - RNA, 318 nt, Artificial Sequence
  derived and/or modified sequence opt4 from anti-influenza_Chain
gacauccagaugacccagagccccagcagccugagcgccagcgugggcgacagagugaccaucaccugcagagccagccagagcaucagcaccuaccugaacugguaccagaagagacccggcaaggcccccaagcugcugguguacggcgccagcagccugcagagcggcgugcccagcagauucagcggcagcggcagcggcaccgacuucacccugaccaucgccagccugcagcccgaggacagcgccguguacuacugccagcagaccuacagcaucccccuguucggccagggcaccagacuggagaucaag

SEQ ID NO: 35248 - RNA, 318 nt, Artificial Sequence
  derived and/or modified sequence opt4 from anti-influenza_Chain
gacauccagaugacccagagccccagcagccugagcgccagcgugggcgacagagugaccaucaccugcagagccagccagagcaucagcagauaccugaacugguaccagcagaagcccggcaaggcccccaagcugcugaucuacggcgccagcacccugcagaacggcgcccccagcagauucagcggcagcggcagcggcaccgacuucacccugaccaucagcagccugcagcccgaggacagcgccaccuaccugugccagcagagcuacagcgugcccgccuucggcggcggcaccaagguggaggugaag

SEQ ID NO: 35249 - RNA, 318 nt, Artificial Sequence
  derived and/or modified sequence opt4 from anti-influenza_Chain
ggcauccagaugacccagagccccagcagccugagcgccagcgugggcgacagagugaccaucaccugcagagccagccagagcaucagcagauaccugaacugguaccugcagaagcccggcaaggcccccaagcugcugaucagcggcgccagcagccugcagagcggcgugcccagcagauucagcggcaccggcagcggcaccgaguucacccugaccaucagcagccugcagcccgaggacuucgccaccuacuacugccagcagaccuucagcaucccccuguucggccagggcaccaagguggagaucaag

SEQ ID NO: 35250 - RNA, 321 nt, Artificial Sequence
  derived and/or modified sequence opt4 from anti-influenza_Chain
gacauccagaugacccagagccccagcagccugagcgccagcgugggcgacagagugagcaucaccugccaggccagccaggacaucagcagauaccugaacugguaccagcagaagcccggcgaggcccccaagcugcugaucuacgacgccagcaaccuggagaccggcgugcccagcagauucagcggcagcggcagcggcaccgacuucaccuucaccaucagcagccugcagcccgaggacaucgccaccuacuucugccagcaguacggcuaccugccccugaccuucggccccggcaccaagguggacagcaag

SEQ ID NO: 35251 - RNA, 321 nt, Artificial Sequence
  derived and/or modified sequence opt4 from anti-influenza_Chain
gacauccagaugacccagagccccagcagcuucagcgugagccugggcgacagagugaccaucaccugcaaggccagcgaggacaucuacaacagacuggccugguaccagcagaagcccggcaacgcccccagacugcugaucagcgacaccaccaaccuguggaucggcgugcccagcagauucagcggcagcggcagcggcaaggacuacacccugagcaucaccagccugcagagcgaggacguggccaccuacuacugccagcaguacuggagcagcagaaccuucggcggcggcaccaagcuggagaucaagaga

SEQ ID NO: 35252 - RNA, 321 nt, Artificial Sequence
  derived and/or modified sequence opt4 from anti-influenza_Chain
gacauccagaugacccagagccccagcagcuucagcgugagccugggcgacagagugaccaucaccugcaaggccagcgaggacaucuacaacagaguggccugguaccagcagaagcccggcaacgcccccagacugcugaugagcgacgccaccagccugggcgccggcgugcccagcagauucagcggcagcggcagcggcaaggaccacacccugagcaucaccagccugcagaccgaggacguggccaccuacuacugccagcaguacuggaacaccagaaccuucggcggcggcaccaagcuggagaucaagaga

SEQ ID NO: 35253 - RNA, 321 nt, Artificial Sequence
  derived and/or modified sequence opt4 from anti-influenza_Chain
gacauccagaugacccagagccccagcagccugagcgccagcgugggcgacagagugaccaucaccugcagagccagccagagcaucagcaccuaccugaacugguaccagcagaagcccggcaucccccccaagcugcugaucaacguggccagcagccugcagagcggcgugcccagcagauucagcggcagcggcagcggcaccgacuucacccugaccaucagcagccugcagcccgaggacuucgccagcuacuacugccagcagaccuacagcagcccccccaccuucggccagggcaccaagguggagaucaag

SEQ ID NO: 35254 - RNA, 321 nt, Artificial Sequence
  derived and/or modified sequence opt4 from anti-influenza_Chain
gacauccagaugacccagagccccagcacccugagcggcagcgugggcgacagagugaccaucaccugcagagccagccagaacaucggccccuggcuggccugguaccagcaggagagcggcaaggcccccaagcugcugaucagcagagccagcauccuggagagcggcgugcccagcagauucagcggcaccggcaccggcaccgaguucacccugaccaucagcagccugcagcccgacgacuucgccaccuacuacugccagcacuacaacgccuacuggggcaccuucggccagggcaccaagguggagaucaac

SEQ ID NO: 35255 - RNA, 321 nt, Artificial Sequence
  derived and/or modified sequence opt4 from anti-influenza_Chain
gugaucuggaugacccagagccccagccugcugagcgccagcaccggcgacagagugaccaucagcugcagaaugagccagggcaucagcagcuaccuggccugguaccagcagaagcccggcaaggcccccgagcugcugauccacaccgccuacacccugaagagcggcgugcccagcagauucagcggcagcggcagcggcaaggacuucacccugaccaucagcggccugcagagcgaggacuucgccaccuacuacugccagcaguacuacagcuuccccuacaccuucggccagggcaccaagguggagaucaag

SEQ ID NO: 35256 - RNA, 321 nt, Artificial Sequence
  derived and/or modified sequence opt4 from anti-influenza_Chain
gacauccagaugacccagagccccagcagcgugagcgccagcgugggcgacagagugaccaucaccugcagagccagccaggacgugagcaccuggcuggccugguaccagcugaagcccggcaaggcccccaagcugcugaucuacgccgccagcagccugcagagcggcgugcccagcagauucagcggcagcggcagcggcaccgacuucacccugaccgugagcagccugcagcccgaggacuucgccaccuacuacugccagcaggccaacagcuuccccuucaccuucggccccggcaccaagguggacaucaag

SEQ ID NO: 35257 - RNA, 321 nt, Artificial Sequence
  derived and/or modified sequence opt4 from anti-influenza_Chain
gacauccagcugacccagagccccagcuuccugagcgccagcgugggcgacggcgugaccaucaccugcagagccagccaggacaucuacaucuaccuggccugguaccagcagaagcccggcaaggcccccaagcugcugaucuacgccgccagcacccugcagggcggcgugcccagcagauucagcggcagcggcagcggcaccgaguucacccugaccaucaacaaccugcagcccgaggacuucgccaccuacuucugccagcagcugaacggcuacccccugaccuucggcggcggcaccaagguggagaucaag

SEQ ID NO: 35258 - RNA, 321 nt, Artificial Sequence
  derived and/or modified sequence opt4 from anti-influenza_Chain
gacauccagcugacccagagccccagcagccugagcgccagcgugggcgacagagugacccugaccugccaggccagccaggacaucagaaaguuccugaacugguaccagcagaagcccggcaagggccccaagcugcugaucuacgacgccagcaaccugcagagaggcgugcccagcagauucagcggcggcggcagcggcaccgacuucacccugaucaucagcagccugcagcccgaggacgugggcaccuacuacugccagcaguacgacggccugcccuucaccuucggcggcggcaccaagcuggagaucaag

SEQ ID NO: 35259 - RNA, 321 nt, Artificial Sequence
  derived and/or modified sequence opt4 from anti-influenza_Chain
gacauccagcugacccagagccccagcagccugagcgccagcaucggcgacagagugaccaucaccugccaggccagccaggacaucagaaacagccugaacugguacgagcacaagcccggcaaggcccccaagcugcugauccacgacgccagcaaccuggagaccggcgugcccagcagauucagcggcggcggcagcggcaccgacuucacccugaccaucagcagccugcagcccgaggacuucgccaccuacuacugccagcaggccaacagcuucccccugaccuucggcggcggcaccaagguggagaucaag

SEQ ID NO: 35260 - RNA, 321 nt, Artificial Sequence
  derived and/or modified sequence opt4 from anti-influenza_Chain
gacauccagcugacccagagccccagcagccugagcgccagcgugggcgacagagugaccaucaccugcagagccagccagggcaucagaaacgaccugggcugguaccagcagaagcccggcaacgcccccaagagacugaucuucggcgccagcagccugcagagcggcgugcccagcagauucagcggcagcggcagcggcaccgaguucacccugaccaucagcagccugcagcccgaggacuucgccaccuacuacugccugcagcacaacagcuaccccuacaccuucggccagggcaccaagcuggagaucaag

SEQ ID NO: 35261 - RNA, 321 nt, Artificial Sequence
  derived and/or modified sequence opt4 from anti-influenza_Chain
gacauccagcugacccagagccccagcagccugagcgccagcgugggcgacagagugaccaucaccugcagagccagccagagcaucagcagauaccugaacugguaccagcagaagcccggcaaggcccccaagcugcugcuguucgccgccagcacccugcuggacggcgugcccagcagauucagcggcagcggcagcggcaccgacuucacccugaccaucagcagccugcagcccgaggacuucgccaccuacuacugccagagaaaccacagccccagcuggaccuucggccagggcaccagaguggagaucaag

SEQ ID NO: 35262 - RNA, 321 nt, Artificial Sequence
  derived and/or modified sequence opt4 from anti-influenza_Chain
gacauccagaugacccagagccccagcagccugagcgccagcgugggcgacagagugaccaugaccugcagagccagccagaacaucagaagcuaccugaacugguaccagcagagacccggcaccgcccccaagcugcugaucuacgccgccagcacccugcacagcggcgugcccagcagauucagcggcggcggcagcggcaccgacuucacccugaccaucaacaaccugcagcccgaggacuucgccagcuacuacugccagcagagcuacgacaacccccagaccuucggccagggcaccaagguggagaucaag

SEQ ID NO: 35263 - RNA, 321 nt, Artificial Sequence
  derived and/or modified sequence opt4 from anti-influenza_Chain
gacauccagaugacccagagccccagcagccugagcgccagcgugggcgacagagugaccaucaccugcagagccaaccaggacaucggcaucuaccugaacugguaccagcagaaccccggcaaggugcccaagcugcugcugcacggcgccagcagccugcagggcggcgugcccagcagauucagcgccagcggcagcggcaccgacuucacccugaccauccacagccugcagcccgaggaccuggccaccuacuacugccagcagagcagaagacugcccuacaccuucggccagggcaccagaguggagcugaag

SEQ ID NO: 35264 - RNA, 321 nt, Artificial Sequence
  derived and/or modified sequence opt4 from anti-influenza_Chain
gacauccagaugacccagagccccagcacccugagcgccagcaucggcgacagagugaccaucaccugcagagccagccagagcaucgccagcuggcuggccugguaccagcagaagcccggcaaggcccccaagcugcugaucuacgaggccgugaaccuggagagcggcgugcccagcagauucagcggcagcggcagcggcaccgacuucacccugaccaucagcagccugcagcccgacgacuucgccaccuacuucugccagcacuacggcaccaucagccagaccuucggcggcggcaccaagguggagaucaag

SEQ ID NO: 35265 - RNA, 321 nt, Artificial Sequence
  derived and/or modified sequence opt4 from anti-influenza_Chain
gacauccagaugacccagagccccagcagccugagcgccagcgugggcgacagagugaccaucaccugcagagccagccagagcaucagcagcuaccugaacugguaccagcacaagcccggcaaggcccccaaggugcugauguacgccgugagcauccugcagagcggcgugcccagcagauucagcggcagcggcagcggcgccgacuucacccugaccaucagcagccugcagcccgaggacuucgccaccuacuacugccagcagagcuacagcagcccccugaccuucggcggcggcaccaagguggagaucaag

SEQ ID NO: 35266 - RNA, 321 nt, Artificial Sequence
  derived and/or modified sequence opt4 from anti-influenza_Chain
gacauccagaugacccagagccccagcagccugagcgccagcgugggcgacagagugaccaucaccugcagagccagccagaacaucaagagauacuucaacugguaccagcagaagcccggcaaggcccccaagcugcugaucuacgccgccagcaaccuggagaacggcgugcccagcagauucagcggcagcggcagcggcaccgacuucacccugaccaucagcagccugcagcccgaggacuucgccaccuacuacugccagcagagcuucagcaagagcuggaccuucggccagggcaccaacguggacaucaag

SEQ ID NO: 35267 - RNA, 321 nt, Artificial Sequence
  derived and/or modified sequence opt4 from anti-influenza_Chain
gacauccagaugacccagagccccagcagccugagcgccagcgugggcgacagagugaccaucaccugcagagccagccagaacaucuacaaguaccugaacugguaccagcagagacccggcaaggcccccaagggccugaucagcgccgccagcggccugcagagcggcgugcccagcagauucagcggcagcggcagcggcaccgacuucacccugaccaucaccagccugcagcccgaggacuucgccaccuacuacugccagcagagcuacagccccccccugaccuucggcggcggcaccagaguggagaucaag

SEQ ID NO: 35268 - RNA, 321 nt, Artificial Sequence
  derived and/or modified sequence opt4 from anti-influenza_Chain
gacauccagaugacccagagccccagcagccugagcagcagcgugggcgacagagugaccaucaccugcagagccagccagagcaucggcgccuacgugaacugguaccagcagaaggccggcaaggccccccaggugcugaucuucggcgccagcaaccugcagagcggcgugcccagcagauucagcggcagcggcagcggcaccgacuucacccugaccaucagcagccugcagcccgaggacuucgccaccuacuucugccagcagaccuacagcacccccaucaccuucggccagggcaccagacuggagaucaag

SEQ ID NO: 35269 - RNA, 321 nt, Artificial Sequence
  derived and/or modified sequence opt4 from anti-influenza_Chain
gacauccagaugacccagagccccagcagccugagcgccagcgugggcgacagagugaccaucagcugcagagccagccagagcaucagcaccuaccugaacugguaccagcagcagcccggcaaggcccccaaggugcugaucuucggcgccaccaaccugcagagcggcgugcccagcagauucagcggcagcggcagcggcaccgacuucacccugaccaucagcagccugcagcccgaggacuucgccaccuacuacugccagcagagcuacaacaccccccugaucuucggccagggcaccaagcuggagaucaag

SEQ ID NO: 35270 - RNA, 321 nt, Artificial Sequence
  derived and/or modified sequence opt4 from anti-influenza_Chain
gacauccagaugacccagagccccagcagccugagcgccagcgugggcgacagagugaccaucagcugcagagccagccagagcaucagcaccuaccugaacugguaccagcagcagcccggcaaggcccccaaggugcugaucagcggcgccaccaaccugcagagcggcgugcccagcagauucagcggcagcggcagcggcaccgacuucacccugaccaucagcagccugcagcccgaggacuucgccaccuacuacugccagcagagcuacaacaccccccugaucuucggccagggcaccaagcuggagaucaag

SEQ ID NO: 35271 - RNA, 321 nt, Artificial Sequence
  derived and/or modified sequence opt4 from anti-influenza_Chain
gacauccagaugacccagagccccagcagccugagcgccagcgugggcgacagacugaccaucaccugcagagccagccagagcaucagcaccuaccugcacugguaccagcagaagcccggcaaggcccccaagcugcugaucuacgccgccagcagccugcagagcggcgugcccagcagauucagcggcagcagaagcggcaccgacuucacccugaccaucagcagccugcagcccgacgacuucgccaccuacuacugccagcagagcuacagccccccccugaccuucggccccggcaccaagguggacaugaag

SEQ ID NO: 35272 - RNA, 321 nt, Artificial Sequence
  derived and/or modified sequence opt4 from anti-influenza_Chain
gacauccagaugacccagagccccagcagccugagcgccagcgugggcgacagagugaccaucaccugcagagccagccagagcaucagcaacuaccugaacugguaccagcacaagcccggcgaggcccccaagcugcugaacuacgccgccagcagccugcagagcggcgugcccagcagauucagcgccagcggcagcggcaccgacuucacccugaccaucagcagccugcagcccgaggacuucgccaccuacuacugccagcagagcuacaacacccccaucaccuucggccagggcaccagacuggagaucaag

SEQ ID NO: 35273 - RNA, 321 nt, Artificial Sequence
  derived and/or modified sequence opt4 from anti-influenza_Chain
gacauccagaugacccagagccccagcagccugagcgccagcgugggcgacagagugaccaucaccugcagagccagccagagcaucagcaacuaccugaacugguaccagcacaagcccggcgaggcccccaagcugcugaacuacgccgccagcagccugcagagcggcgugcccagcagauucagcgccagcggcagcggcaccgacuucacccugagcaucagcggccugcagcccgaggacuucgccaccuacuacugccagcagagcuacaacacccccaucaccuucggccccggcaccagacuggagaucaag

SEQ ID NO: 35274 - RNA, 321 nt, Artificial Sequence
  derived and/or modified sequence opt4 from anti-influenza_Chain
gacauccagaugacccagagccccagcagccugagcgccagcgugggcgacagagugaccaucaccugcagagccagccagagcaucagcaccuaccugaacugguaccagcagaagcccggcaaggcccccaagcugcugaucuacgccgccagcagccugcacagcggcgugcccagcagauucagcggcagcggcagcggcaccgacuucgcccugaccaucagcagccugcagcccgaggacuucgccaccuacuacugccagcagagcuacagcccccccaucaccuucggccagggcaccagacuggagaucaag

SEQ ID NO: 35275 - RNA, 321 nt, Artificial Sequence
  derived and/or modified sequence opt4 from anti-influenza_Chain
gacauccagaugacccagagccccagcagccugagcgccagcgugggcgacagagugaccaucaccugcagagccagccagaccaucagcaccuaccugaacugguaccagcagaagagcggcaaggcccccaagcugcugaucuacgccgccagcggccugcagagcggcgugcccagcagauucagcggcagcggcagcggcaccgacuucacccugaccaucagcagccugcagcccgaggacuucgccaccuacuucugccagcagagcuacaacaccccccugaccuucggccagggcaccaagguggagaucaag

SEQ ID NO: 35276 - RNA, 321 nt, Artificial Sequence
  derived and/or modified sequence opt4 from anti-influenza_Chain
gacauccagaugacccagagccccagcagccugagcgccagcgugggcgacagagugaccaucagcugcagagccagccagagcaucagcaccuaccugaacugguaccagcagcagcccggcaaggcccccaaggugcugaucagcggcgccaccgaccugcagagcggcgugcccagcagauucagcggcagcggcagcggcaccgacuucacccugaccaucagcagccugcagcccgaggacuucgccaccuacuacugccagcagagcuacaacaccccccugaucuucggccagggcaccaagcuggagaucaag

SEQ ID NO: 35277 - RNA, 321 nt, Artificial Sequence
  derived and/or modified sequence opt4 from anti-influenza_Chain
gacauccaggugacccagagccccagcagccugagcgccagcgugggcgacagagugaccaucaccugcagagccagccagaacaucuacaaguaccugaacugguaccagcagagacccggcaaggcccccaagggccugaucagcgccgccagcggccugcagagcggcgugcccagcagauucagcggcagcggcagcggcaccgacuucacccugaccaucaccagccugcagcccgaggacuucgccaccuacuacugccagcagagcuacagccccccccugaccuucggcggcggcaccagaguggacaucaag

SEQ ID NO: 35278 - RNA, 321 nt, Artificial Sequence
  derived and/or modified sequence opt4 from anti-influenza_Chain
cagagcgugcugacccagccccccagcgagagcgugagccccggccagaccgccagcgugaccugcagcggccacaagcugggcgacaaguacgugagcugguaccagcagaagcccggccagagccccgugcugcugaucuaccaggacaacagaagacccagcggcauccccgagagauucaucggcagcaacagcggcaacaccgccacccugaccaucagcggcacccaggcccuggacgaggccgacuacuacugccaggccugggacagcagcaccgccguguucggcggcggcaccaagcugaccgugcugggc

SEQ ID NO: 35279 - RNA, 321 nt, Artificial Sequence
  derived and/or modified sequence opt4 from anti-influenza_Chain
gacauccagcugacccagagccccagcagccugagcgccagcgugggcgacagagugaccaucaccugcagagccagccagggcaucagcaccuaccuggccugguaccagcagaagcccggcaaggugcccaagcugcugaucuacgccgccagcacccugcagagcggcgugcccagcagauucagcggcagcggcagcggcaccgacuucacccugaccaucagcagccugcagcccgaggacguggccaccuacuacugccagaaguacaacagcgcccccagcuucggccccggcaccaagguggacaucaagaga

SEQ ID NO: 35280 - RNA, 321 nt, Artificial Sequence
  derived and/or modified sequence opt4 from anti-influenza_Chain
agcgugcugacccagccccccagcgccagcggcagcagaggccagagcaucaccaucagcugcaccggcagcaccagcgacaucggcagcuacaacuacgugagcugguaccagcagcaccccggcaccgcccccaaggugauccuguacgaggugagccagagacccagcggcgugcccgacagauucagcggcagcaagagcggcaacaccgccuuccugaccgugagcggccugcaggccgaggacgaggccgacuacuacugcgccagcuacgccggcaacaacaucuacguguucggcagcggcaccaaggugacc

SEQ ID NO: 35281 - RNA, 321 nt, Artificial Sequence
  derived and/or modified sequence opt4 from anti-influenza_Chain
agcgcccugacccagccccccagcgccagcggcagcagaggccagagcaucaccaucagcugcaccggcagcaccagcgacaucggcagcuacaacuacgugagcugguaccagcagcaccccggcaccgcccccaaggugauccuguacgaggugagccagagacccagcggcgugcccgacagauucagcggcagcaagagcggcaacaccgccuuccugaccgugagcggccugcaggccgaggacgaggccgacuacuacugcgccagcuacgccggcaacaacaucuacguguucggcagcggcaccaaggugacc

SEQ ID NO: 35282 - RNA, 321 nt, Artificial Sequence
  derived and/or modified sequence opt4 from anti-influenza_Chain
gagaucgugcugacccagagccccgccacccugagccugagccccggcgagagagccacccugagcugcagagccagccagagcgugagcaccuuccuggccugguaccagcagaagcccggccaggcccccagacugcugauguacgacgccagcaacagagccaccggcauccccgccagauucagcggcagcggcagcggcaccgacuucacccugaccaucagcagccuggagcccgaggacuucgccaucuacuacugccagcagagaagccacuggccccccaucuucggccagggcaccagacuggagaucaag

SEQ ID NO: 35283 - RNA, 321 nt, Artificial Sequence
  derived and/or modified sequence opt4 from anti-influenza_Chain
gacauccagaugacccagagccccgccagccugagcgugagcgugggcgagaccgugaccaucaccugcagagccagcgagaagaucuacagcaaccuggccugguaccagcagaaggagggcaagagcccccagcugcugguguacgccgccaucagacuggccgacggcgugcccagcagauucagcggcagcggcagcggcacccaguucagccugaagaucaacagccugcagagcgaggacuucggcaccuacuacugccagcacuucuggggcaccccccugaccuucggcgccggcaccaagcuggagcugaag

SEQ ID NO: 35284 - RNA, 321 nt, Artificial Sequence
  derived and/or modified sequence opt4 from anti-influenza_Chain
gacauccagaugacccagagccccagcagcgugagcgccagcgugggcgacagagugaccaucaccugcagagccagccaggacaucagcaccuggcuggccugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuucugccagcaggccaacagcuucccccccaccuucggccagggcaccaagcuggagaucaag

SEQ ID NO: 35285 - RNA, 321 nt, Artificial Sequence
  derived and/or modified sequence opt4 from anti-influenza_Chain
gacauccagaugacccagagccccagcagcgugagcgccagcgugggcgacagagugaccaucaccugcagagccagccaggacaucagcaccuggcuggccugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuucugccagcaggccaacagcuucccccccaccuucggcugcggcaccaagcuggagaucaag

SEQ ID NO: 35286 - RNA, 321 nt, Artificial Sequence
  derived and/or modified sequence opt4 from anti-influenza_Chain
gacauccagaugacccagagccccagcagcgugagcgccagcgugggcgacagagugaccaucaccugcagagccagccaggacaucagcaccuggcuggccugguaccagcagaagcccggcaagugccccaagcugcugaucuacgccgccagcagccugcagagcggcgugcccagcagauucagcggcagcggcagcggcaccgacuucacccugaccaucagcagccugcagcccgaggacuucgccaccuacuucugccagcaggccaacagcuucccccccaccuucggccagggcaccaagcuggagaucaag

SEQ ID NO: 35287 - RNA, 321 nt, Artificial Sequence
  derived and/or modified sequence opt4 from anti-influenza_Chain
gacauccagaugacccagagccccagcagcgugagcgccagcgugggcgacagagugaccaucaccugcagagccagccaggacaucagcaccuggcuggccugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcaggccaacagcuucccccccaccuucggccagggcaccaagcuggagaucaag

SEQ ID NO: 35288 - RNA, 321 nt, Artificial Sequence
  derived and/or modified sequence opt4 from anti-influenza_Chain
gacauccagaugacccagagccccagcagcgugagcgccagcgugggcgacagagugaccaucaccugcagagccagccaggacaucagcaccuggcuggccugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcaggccaacagcuucccccccaccuucggcugcggcaccaagcuggagaucaag

SEQ ID NO: 35289 - RNA, 321 nt, Artificial Sequence
  derived and/or modified sequence opt4 from anti-influenza_Chain
gacauccagaugacccagagccccagcagcgugagcgccagcgugggcgacagagugaccaucaccugcagagccagccaggacaucagcaccuggcuggccugguaccagcagaagcccggcaagugccccaagcugcugaucuacgccgccagcagccugcagagcggcgugcccagcagauucagcggcagcggcagcggcaccgacuucacccugaccaucagcagccugcagcccgaggacuucgccaccuacuacugccagcaggccaacagcuucccccccaccuucggccagggcaccaagcuggagaucaag

SEQ ID NO: 35290 - RNA, 321 nt, Artificial Sequence
  derived and/or modified sequence opt4 from anti-influenza_Chain
gagaucgugcugacccagagccccgccacccugagccugagccccggcgagagagccacccugagcugcagagccagcagaagcaucaccaccuuccuggccugguaccagcagaagcccggccaggcccccagacugcugaucuacgacgccagcaacagagccaccggcgugcccgccagauucagcggcagcggcagcggcaccgacuucacccugaccaucaacagccuggagcccgacgacuucgccaucuacuacugccagcagagagaccacuggccccccaucuucggccagggcaccagacuggagaucaag

SEQ ID NO: 35291 - RNA, 321 nt, Artificial Sequence
  derived and/or modified sequence opt4 from anti-influenza_Chain
gagaucgugcugacccagagccccgccacccugagccugagccccggcgagagagccacccugagcugcagagccagcagaagcaucaccaccuuccuggccugguaccagcagaagcccggccaggcccccagacugcugaucuacgacgccagcaacagagccaccggcgugcccgccagauucagcggcagcggcagcggcaccgacuucacccugaccaucaacagccuggagcccgacgacuucgccaucuacuacugccagcagagagaccacuggccccccaucuucggcugcggcaccagacuggagaucaag

SEQ ID NO: 35292 - RNA, 324 nt, Artificial Sequence
  derived and/or modified sequence opt4 from anti-influenza_Chain
gagaucgugcugacccagagccccggcacccugagccugagccccggcgagagagccacccugagcugcagagccagccagaccgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcaacagccccuacaccuucggccagggcaccaagcuggagaucaag

SEQ ID NO: 35293 - RNA, 324 nt, Artificial Sequence
  derived and/or modified sequence opt4 from anti-influenza_Chain
gagaucgugcugacccagagccccggcacccugagcgugagccccggcgagagagccacccugagcugcagagccagccagagcaucagcagcggcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcaccagcccccagaccuucggccagggcaccaagguggagaucaag

SEQ ID NO: 35294 - RNA, 324 nt, Artificial Sequence
  derived and/or modified sequence opt4 from anti-influenza_Chain
gagguggugcugacccagagccccggcacccugagccugagccccggccagagagccacccugagcugcagagccagccagagcgugagcagcagcuaccuggccugguaccagcagaagcccggccaggcccccagacugcugaucuacgacgccagcaacagagccaccggcauccccgacagauucagcggcagcggcagcggcaccgacuucacccugaccaucagcagacuggagcccgaggacuucgccguguacuacugccagcaguacggcagcagccccuacaccuucggccagggcaccaagcuggagaucaag

SEQ ID NO: 35295 - RNA, 324 nt, Artificial Sequence
  derived and/or modified sequence opt4 from anti-influenza_Chain
gacauccagcugacccagagccccagcagccugagcgccagcgugggcgacagagugaccaucaccugcagagccagccagggcaucaucaccuaccugaacugguaccagcagaagcccggcaaggcccccaagcugcugaucuacgccaccuacagccugcagaacggcgugcccagcagauucagcggcagcggcagcggcaccgacuucacccugaccaucagcagccugcagcccgaggacuucgccaccuacuacugccagcagagcuacagcagccugauguucaccuucggccagggcaccaagcuggacaucaag

SEQ ID NO: 35296 - RNA, 324 nt, Artificial Sequence
  derived and/or modified sequence opt4 from anti-influenza_Chain
gagaccgugcugacccagagccccggcacccugagccugacccccggcgagagagccacccugagcugcagagugggccagagcgugagcggcagccaccuggccugguaccagcagaagcccggccaggcccccagacugcugaucuacggcgccagcagcagagccaccggcauccccgacagauucggcggcagcgugagcggcaccgacuucacccugaccaucagcagacuggagcccgaggacagcgccguguacuacugccagcaguacggcgacagcagauacaccuucggccagggcaccaagcuggagaucaag

SEQ ID NO: 35297 - RNA, 324 nt, Artificial Sequence
  derived and/or modified sequence opt4 from anti-influenza_Chain
gagaucgugcugacccagagccccggcacccugagccugagccccggcgagagagccacccugagcugcagagccagccagagcgugagcagcagccagcuggccugguaccagcagaagcccggccaggcccccagacugaucaucuacggcgccagcaccagagccaccggcauccccgacagauucagcggcagcggcagcggcaccgacuucacccugaccaucggcagacuggagcccgaggacuucgccguguucuucugccagcaguacagcaccagcccccccaccuucggccagggcaccaagguggacuucaag

SEQ ID NO: 35298 - RNA, 324 nt, Artificial Sequence
  derived and/or modified sequence opt4 from anti-influenza_Chain
gacaucgugcugacccagagccccggcacccugagccugagccccggcgagagagccacccugagcugcagagccagccagagcgugagcagcagcuaccuggccugguaccagcagaagcccggccaggcccccagacuggugauguacggcgccgccaccagagccaccggcauccccgacagauucagcggcagcggcagcggccccgacuucacccugaccaucagcagacuggagcccgaggacuucgccauguacuacugccagcaguacggcaacagccccaucaccuucggccagggcaccagacuggagaucaag

SEQ ID NO: 35299 - RNA, 324 nt, Artificial Sequence
  derived and/or modified sequence opt4 from anti-influenza_Chain
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagccacuggccccccaucaccuucggccagggcaccagacuggagaucaag

SEQ ID NO: 35300 - RNA, 324 nt, Artificial Sequence
  derived and/or modified sequence opt4 from anti-influenza_Chain
agcuacgagcugacccagccccccagcgugagcgugagccccggccagaccgccagaaucaccugcagcggcgacgcccugcccaagcagaacgccuacugguaccagcagaagcccggccaggcccccgugcugcugaucuacaaggacagcgagagacccagcggcauccccgagagauucagcggcagcagcagcggcaccaccgugacccugaccaucagcggcgugcaggccgaggacgaggccgacuacuacugccagagcgccgacagcagcggcaccagcuggguguucggcggcggcaccaagcugaccgugcug

SEQ ID NO: 35301 - RNA, 324 nt, Artificial Sequence
  derived and/or modified sequence opt4 from anti-influenza_Chain
agcuacgugcugacccaggcccccagcgugagcguggcccccggccagaccgccagaaucaccugcggcggcaacgccaucggcagcaagaaggugcacugguaccagcacaaggccggccaggcccccgugcuggugguguacgacgacaccgacagacccagcggcauccccgagagauucagcggcagcaacagcuggagcaccgccacccugaccaucaacagaguggaggccggcgacgaggccgacuacuacugccaggugugggacuucaccaucgaccacgugguguucggcggcggcaccaagcugaccgugcug

SEQ ID NO: 35302 - RNA, 324 nt, Artificial Sequence
  derived and/or modified sequence opt4 from anti-influenza_Chain
gagaucgugcugacccagagccccggcacccugagccugagccccggcgagagagccacccugagcugcagagccagccagagcgugagcagcagcuaccuggccugguaccagaagaagcccggccaggcccccagacugcugaucuacggcgccagcaccagagccaccggcauccccgacagauucaccggcagcggcagcggcaccgacuucacccugagcaucagcagacuggagcccgaggacuucgccguguacuacugccagcacuucggcaccagcguguucaccuucggcggcggcaccaagguggagaucaag

SEQ ID NO: 35303 - RNA, 324 nt, Artificial Sequence
  derived and/or modified sequence opt4 from anti-influenza_Chain
gagaucgugaugacccagagccccgccacccugagcgugagccccggcgagagagccacccugagcugcagagccagccagagcgugggcaacagccuggccugguaccagcagagacccggccaggcccccagacugcugaucuacggcgccagcaccagagccaccggcaucccccccagauucagcggcagcggcagcggcaccgaguucacccugaccaucagcagccugcagaccgaggacuucgccguguacuacugccagcaguacaucaacuggagaccccugagcuucggcggcggcaccaagguggagaucaag

SEQ ID NO: 35304 - RNA, 324 nt, Artificial Sequence
  derived and/or modified sequence opt4 from anti-influenza_Chain
caggagagcggcgccgagcuggugagacccggcgccagcgugaagcugagcugcaaggacagcggcuacaccuucaccaccuacuggaugaacugggugaagcagagacccgagcagggccuggaguggaucggcagaaucgaccccuacgacagcgagacccacuacaaccagaaguucaaggacaaggccauccugaccguggacaagagcagcaacaccgccuacaugcagcugagcagccugaccagcgaggacagcgccguguacuacugcgugagaggcggcagcaccguggccuacuucggcguguggggccagggc

SEQ ID NO: 35305 - RNA, 324 nt, Artificial Sequence
  derived and/or modified sequence opt4 from anti-influenza_Chain
gagaucgugcugacccagagccccggcacccugagccugagccccggcgagagagccacccugagcugcagagccagccagagagugagcagcuaccuggccugguaccagcagaagcccggccaggcccccagacugcugaucuacggcgccagcaccagagccgccggcauccccgacagauucagcggcagcggcagcggcaccgacuucacccugaccaucagcagacuggagcccgaggacagcgccguguacuacugccagcaguacggcagaaccccccugaccuucggcggcggcaccaagguggagaucaagaga

SEQ ID NO: 35306 - RNA, 324 nt, Artificial Sequence
  derived and/or modified sequence opt4 from anti-influenza_Chain
gagaucgugaugacccagagccccggcacccugagccugagccccggcgagagagccacccugagcugcagagccagccagagcgugagcagcagcuaccuggccugguaccagcagaagcccggccaggcccccagacugcugaucuucggcgccagcagcagagccaccggcauccccgacagauucagcggcagcggcagcggcaccgacuucacccugaccaucagcagacuggagcccgaggacuucgccguguacuacugccagcaguacggcagcagccugaccuucggcggcggcaccaagcuggagaucaagaga

SEQ ID NO: 35307 - RNA, 324 nt, Artificial Sequence
  derived and/or modified sequence opt4 from anti-influenza_Chain
gagaucgugcuguaccagagccccggcacccugagccugagccccggcgagagagccacccugagcugcagagccagccagagagugagcagcuaccuggccugguaccagcagaagcccggccaggcccccagacugcugaucuacggcgccagcaccagagccgccggcauccccgacagauucagcggcagcggcagcggcaccgacuucacccugaccaucagcagacuggagcccgaggacagcgccguguacuacugccagcaguacggcagaaccccccugaccuucggcggcggcaccaagguggagaucaagaga

SEQ ID NO: 35308 - RNA, 324 nt, Artificial Sequence
  derived and/or modified sequence opt4 from anti-influenza_Chain
gacaucgugcugacccaggcccccagcgugagcgugagccccggccagaccgccagcaucaccugcagcggcgacagacugggcgagaaguucgccagcugguaccagcagaagcccggccagagccccgugcuggugaucuacgaggacagcaagagacccagcggcauccccgacagauucagcggcagcaacagcggcaacaccgccacccugaccaucagcggcacccagaucauggacgagggcgacuucuucugccaggccugggacagcagcaccgugguguucggcggcggcaccaagcugaccgugcugggccag

SEQ ID NO: 35309 - RNA, 324 nt, Artificial Sequence
  derived and/or modified sequence opt4 from anti-influenza_Chain
gacaucgagcugacccagagccccagcgugagcgugagccccggccagaccgccagcaucaccugcagcggcgacaagcugggcgacaaguucgugugcugguaccagcagaaggccggccagagccccaucguggugaucuaccaggacgacaagagacccagcggcauccccgagagauucagcggcagcaacagcggcaacaccgccacccugaccaucagcggcacccaggccauggacgaggccgacuacuucugccaggccugggacagcaccaccgugguguucggcggcggcaccaagcugaccgugcugggccag

SEQ ID NO: 35310 - RNA, 324 nt, Artificial Sequence
  derived and/or modified sequence opt4 from anti-influenza_Chain
cagagcgugcugacccagccccccagcgccagcggcagcagaggccagagcaucaccaucagcugcaccggcagcaccagcgacaucggcagcuacaacuacgugagcugguaccagcagcaccccggcaccgcccccaaggugauccuguacgaggugagccagagacccagcggcgugcccgacagauucagcggcagcaagagcggcaacaccgccuuccugaccgugagcggccugcagaccgacgacgaggccgacuacuacugcgccagcuacgccggcaacaacaucuacguguucggcagcggcaccaaggugacc

SEQ ID NO: 35311 - RNA, 327 nt, Artificial Sequence
  derived and/or modified sequence opt4 from anti-influenza_Chain
aacuucaugcugacccagccccacagcgugagcgagagccccggcaagaccgugaccaucagcugcaccggcagcggcggcaacaucgccagaaacuacgugcagugguaccagcagagacccggcagcgcccccgugaccgugauccuggaggacgacaagagacccagcggcauccccgacagauucagcggcagcaucgacagaagcagcaacagcgccagccugaccaucagcggccugagaaccgaggacgaggcccuguacuacugccagagcuacgacgacagcgaccuggugguguucggcggcggcaccaagcugacc

SEQ ID NO: 35312 - RNA, 327 nt, Artificial Sequence
  derived and/or modified sequence opt4 from anti-influenza_Chain
augcuggagccccugcagauccugagcaucugcagcuucauccugagcgcccugcacuucauggccuggaccaucggccaccugaaccagaucaagagaggcgugaaccugaagauccagaucagaaaccccaacaaggaggccaucaacagagaggugagcauccugagacacaacuaccagaaggagauccaggccaaggagaccaugaagaagauccugagcgacaacauggaggugcugggcgaccacaucgugguggagggccugagcaccgacgagaucaucaagaugggcgagaccgugcuggagguggaggagcugcag

SEQ ID NO: 35313 - RNA, 327 nt, Artificial Sequence
  derived and/or modified sequence opt4 from anti-influenza_Chain
gacaucagacugacccagagccccgccacccugagcgugagccccggcgagagagccacccugagcugcagagccagccacagcgugagcagaaaccuggccugguaccagcagaagcccggcagagcccccagacugcugguguacgacaccagcagcagagccaccggcauccccgccagauucagcggcagcggcagcggcaccgaguucacccugaccaucagcagccugcagagcgaggacuucgccguguacuacugccagcaguacaacaacuggcccagaaccuucggccagggcaccaagguggacaucaagagaacc

SEQ ID NO: 35314 - RNA, 327 nt, Artificial Sequence
  derived and/or modified sequence opt4 from anti-influenza_Chain
gagaucgugaugacccagagccccggcacccugagccugagccccggcgagagagccacccugagcugcagagccagccagagcgugagcagcagcuaccuggccugguaccagcagaagcccggccaggcccccagacugcugaucuacggcgccagcaccagagccaccggcgugcccgacagauuccacggcggcggcagcggcaccgacuucacccugaccaucagcagacuggagcccgaggacuucgccguguacuacugccagcaguacgacaccagcagcggccugaccuucggcggcggcaccaagguggagaucaag

SEQ ID NO: 35315 - RNA, 327 nt, Artificial Sequence
  derived and/or modified sequence opt4 from anti-influenza_Chain
gagaucgugaugacccaguuccccgccacccugagcgugagccccggcgagagagugacccugagcugcagagccagccagagcgugagcaacaaccuggccugguaccagcagaagcccggccagccccccagacugcugaucuacgacgccagcaccagagccaccggcgugcccgccaaguucagcggcaccggcagcggcaccgaguucacccugagcaucagcagccugcagagcgaggacuucgccguguacuacugccagcaguaccacaacuggccccccagcuacagcuucggccugggcaccaagcuggagaucaag

SEQ ID NO: 35316 - RNA, 327 nt, Artificial Sequence
  derived and/or modified sequence opt4 from anti-influenza_Chain
gagaucauccuggcccagagccccggcacccugagccugagccccggcgagagagccacccugagcugcagagccagccaguucgugagcaccagaagccuggccugguaccagcagagacccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcacuacggcuacagccccagauacgccuucggccagggcagcaagguggagaucaag

SEQ ID NO: 35317 - RNA, 327 nt, Artificial Sequence
  derived and/or modified sequence opt4 from anti-influenza_Chain
gagaucgugcugacccagagccccggcacccugagccugagccccggcgagagagccacccugagcugcagagccagccacuucgugaacuacagaagccuggccugguaccagcagacccccggccaggugcccagacugcugaucuacggcgccagcaccagagccaccggcauccccgacagauucagcggcagcggcagcggcaccgacuucacccugaccaucagcagacuggagcccgaggacuucgccguguacuucugccagcaguacggcggcagccccagauacaccuucggccagggcaccagacuggagaucaag

SEQ ID NO: 35318 - RNA, 327 nt, Artificial Sequence
  derived and/or modified sequence opt4 from anti-influenza_Chain
gagaucgugcugacccagagccccggcacccugagccugagccccggcgagagagccacccugagcugcagagccagccacuucgugaucggcagagccguggccugguaccagcagaagcccggccaggcccccagacugcugaucuacggcgccagcagcagagccaccggcauccccgacagauucagcggcagcggcagcggcaccgacuucacccugaccaucagcagacuggagaccgaggacuucgccguguucuacugccagcacuacggcagcagccccagauacgccuucggccagggcaccaagcuggagaucaag

SEQ ID NO: 35319 - RNA, 327 nt, Artificial Sequence
  derived and/or modified sequence opt4 from anti-influenza_Chain
gagaucgugcugacccagagccccgccacccugagccugagccccggcgagagagccacccugagcugcagagccagccagagcgugggcaacuaccuggccugguaccagcagaagcccggccaggcccccagacugcugaucuacgacagcagcaacagagcccccggcauccccgccagauucagcggcagcggcagcggcaccgacuucacccugaccaucagcagccuggcccccgaggacuucgccguguacuacugccagcagagaagcaaguggccccccauguacagcuucggccacggcaccaagcuggagaucaag

SEQ ID NO: 35320 - RNA, 327 nt, Artificial Sequence
  derived and/or modified sequence opt4 from anti-influenza_Chain
caggccguggugacccaggagcccagccugaccgugagccccggcggcaccgugacccugaccugcggcagcagcaccggccccgugaccagcggccacuaccccuacugguuccagcagaagcccggccaggcccccagaacccugaucagcgccaccagcaacacccacagcuggacccccgccagauucagcggcagccugcugggcggcagagccgcccugacccugagcggcgcccagcccgaggacgaggccgacuacuacugcuuccugagcuacagcggcgccuggguguucggcggcggcaccacccugaccgugcug

SEQ ID NO: 35321 - RNA, 327 nt, Artificial Sequence
  derived and/or modified sequence opt4 from anti-influenza_Chain
gccauccagaugacccagagccccagcagccugagcgccagcgugggcgacagagugaccaucaccugcagagccagccagaacaucagaagcuaccugaacugguaccagcagaagcccggcaaggcccccaaccugcugaucuacggcaccaccagccuggagagcggcgugcccagcagauucagcggcagcggcagcggcaccgacuucacccugaccaucagcagccugcagcccgaggacuucgccaccuacuacugccagcagagcuaccacaccccccagaccuucggccagggcaccaagguggagaucaagagaacc

SEQ ID NO: 35322 - RNA, 327 nt, Artificial Sequence
  derived and/or modified sequence opt4 from anti-influenza_Chain
gacauccagaugacccagagccccagcagccugagcgccagcgugggcgacagaaucaccaucaccugcagagccagccagggcaucgacaacuaccuggccugguuccagcagaagcccggcaaggugcccgagcugcugaucuacgccgccagcacccugcagagcggcgugcccagcagauucagcggcagcggcagcggcaccggcuucacccugaccaucagcagccugcagcccgaggacguggccaccuacuacugccagaaguacgacagcgccccccugaccuucggcggcggcaccaagguggacaucaagagaacc

SEQ ID NO: 35323 - RNA, 327 nt, Artificial Sequence
  derived and/or modified sequence opt4 from anti-influenza_Chain
gacauccagcugacccagagccccagcagccugagcgccagcgugggcgacagagugaccaucaccugcagagccagccagggcaucaccgacuaccuggccugguaccagcagaagcccggcaccauccccaagcugcugaucuacgccgccagcacccugcagagcggcgugcccagcagauucagcggcggcggcuacggcaccgacuucacccugaccaucagcagccugcagcccgaggacguggccaccuacuacugccagaaguacaacagcgccccccugaccuucggcggcggcaccaagguggagaucaagagaacc

SEQ ID NO: 35324 - RNA, 327 nt, Artificial Sequence
  derived and/or modified sequence opt4 from anti-influenza_Chain
gacaucgugaugacccagagccccuucagccugagccugagccccggcgagagagccacccugagcugcagagccagccagagcaucagcaacuaccuggccugguaccagcagaagcccggccaggcccccagacugcugaucuacgacagcagcaacagagccaccggcgugcccgccagauucagcggcagcggcagcggcaccgacuucacccugaccaucagcagccuggagcccgaggacuucgccguguacuacugccagcagagaagcaacuggauguacaccuucggccagggcaccaagguggagaucaagagaacc

SEQ ID NO: 35325 - RNA, 327 nt, Artificial Sequence
  derived and/or modified sequence opt4 from anti-influenza_Chain
gacauccagaugacccagagccccagcagccugagcgccagcgugggcgacagagugaccaucaccugcagagccagccagggcaucagcagcuaccuggccugguaccagcagaagcccggcaaggugcccacccugcugaucuacgacgccagcacccugagaagcggcgugcccagcagauucagcggcagcggcagcgccaccgacuucacccugaccaucagcagccugcagcccgaggacguggccaccuacuacugccagagauacaacagcgccccccccaucaccuucggccagggcaccagacuggagaucaagaga

SEQ ID NO: 35326 - RNA, 327 nt, Artificial Sequence
  derived and/or modified sequence opt4 from anti-influenza_Chain
gagaucgugaugacccagagccccggcacccugagccugagccccggcgagagagccacccugagcugcagagccagccagagcgugagcagcagcuaccuggccugguaccagcagaagcccggccaggcccccagacugcugaucuacgacgccagcagcagagccaccgacauccccgacagauucagcggcagcggcagcggcaccgacuucacccugaccaucagcagacuggagcccgaggacuucgccguguacuacugccagcaguacggcagcagccuguggaccuucggccagggcaccaagguggagaucaagaga

SEQ ID NO: 35327 - RNA, 327 nt, Artificial Sequence
  derived and/or modified sequence opt4 from anti-influenza_Chain
agcuacgugcugacccagccccccagcgugagcguggcccccggccagaccgccagaaucaccugcggcggcaacaacaucggcagcaagagcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacgccguguucggcggcggcacccagcugaccgugcugggc

SEQ ID NO: 35328 - RNA, 327 nt, Artificial Sequence
  derived and/or modified sequence opt4 from anti-influenza_Chain
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccccagaaccuucggcggcggcaccaagguggagaucaagaga

SEQ ID NO: 35329 - RNA, 327 nt, Artificial Sequence
  derived and/or modified sequence opt4 from anti-influenza_Chain
agcuacgugcugacccagccccccagcgugagcguggcccccggccagaccgccagaaucaccugcggcggcaacaacaucggcagcaagggcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacgugguguucggcggcggcaccaagcugaccgugcugggc

SEQ ID NO: 35330 - RNA, 327 nt, Artificial Sequence
  derived and/or modified sequence opt4 from anti-influenza_Chain
gagaucgugcugacccagagccccggcacccugagccugagccccggcgagagagccacccugagcugcagagccagccagagcgugagcagcaacuaccugggcuggacccagcagaagcccggccaggcccccagacugcugaucuacggcgccagcagcagagccagcggcauccccgacagauucagcggcggcggcagcggcaccgacuucacccugaccaucagcagacuggagcccgaggacuucgccguguacuacugccagcaguacggcagcagcccccugaccuucggcggcggcaccaagguggagaucaagaga

SEQ ID NO: 35331 - RNA, 327 nt, Artificial Sequence
  derived and/or modified sequence opt4 from anti-influenza_Chain
cagagcguggugacccagccccccagcgugagcguggcccccggccagaccgccagaaucaccugcggcggcaacaacaucggcagcaagagcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacuacguguucggcaccggcaccaaggugaccgugcugggc

SEQ ID NO: 35332 - RNA, 327 nt, Artificial Sequence
  derived and/or modified sequence opt4 from anti-influenza_Chain
agcuacgugcugacccagccccccagcgagagcguggcccccggccagaccgccagaaucaccugcggcggcaacaacaucggcagaaacagcgugcacugguaccagcagaagcccggccaggcccccgugcuggugguguacgacgacagcgacagacccagcggcauccccgagagauucagcggcagcaagagcggcaacaccgccacccugaucaucagcagaguggaggugggcgacgaggccgacuacuacugccagguguggcacagcagcagcgaccacuacguguucggcaccggcaccaaggugaccgugcugggc

SEQ ID NO: 35333 - RNA, 327 nt, Artificial Sequence
  derived and/or modified sequence opt4 from anti-influenza_Chain
gagaucgugaugacccagagccccggcacccugagccugagccccggccagagagccacccugagcugcagagccagccagagcgugagcagcagcuaccuggccugguaccagcagaagcccggccaggcccccagacugcugauguacggcgccagcagcagagccaccggcauccccgacagauucagcggcagcggcagcggcaccgacuucacccugaccaucagcagacuggagcccgaggacuucgccguguacuacugccagcaguacggcagcagcagccugaccuucggcggcggcaccaagcuggagaucaagaga

SEQ ID NO: 35334 - RNA, 327 nt, Artificial Sequence
  derived and/or modified sequence opt4 from anti-influenza_Chain
caggccggccugacccagccccccagcgugagcguggcccccggccagaccgccagaaucaccugcggcggcaacaacaucggcagcaagagcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacgugguguucggcggcggcaccaagcugaccgugcugggc

SEQ ID NO: 35335 - RNA, 327 nt, Artificial Sequence
  derived and/or modified sequence opt4 from anti-influenza_Chain
cagagcguggugacccagccccccagcgagagcguggcccccggccagaccgccagaaucaccugcggcggccacaacaucggcagcaacagcgugcacugguaccagcagaagcccggccaggcccccgugcuggugguguacgacaacagcgacagacccagcggcauccccgagagauucagcggcagcaacagcggcaacaccgccacccugaccaucagcagaguggaggccggcgacgaggccgacuacuacugccagguguggggcagcagcagcgaccacuacguguucggcaccggcaccaaggugaccgugcugggc

SEQ ID NO: 35336 - RNA, 327 nt, Artificial Sequence
  derived and/or modified sequence opt4 from anti-influenza_Chain
gagaucgugcugacccagagccccggcacccugagccugagccccggcgagagagccacccugagcugcagagccagccagagcgugagcagcaacuaccugggcugguaccagcagaagcccggccaggcccccagacugcugaucuacggcgccagcagcagagccagcggcauccccgacagauucagcggcggcggcagcggcaccgacuucacccugaccaucagcagacuggagcccgaggacuucgccguguacuacugccagcaguacggcagcagcccccugaccuucggcggcggcaccaagguggagaucaagaga

SEQ ID NO: 35337 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccagagcguggacagcaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuggccccccagacugaccuucggcggcggcagcaagguggagaucaag

SEQ ID NO: 35338 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccagagcgugagccacaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuacccccccagacugaccuucggcggcggcagcaagguggagaucaag

SEQ ID NO: 35339 - RNA, 327 nt, Artificial Sequence
  derived and/or modified sequence opt4 from anti-influenza_Chain
gagaucgugaugacccagagccccgccacccugagcgugagccccggcgagagagccacccugagcugcagagccagccagagcguggacagcaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuggccccccagacugaccuucggcggcggcagcaagguggagaucaag

SEQ ID NO: 35340 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccagagcgugagcagcaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuggccccccagacugaccuucggcggcggcagcaagguggagaucaag

SEQ ID NO: 35341 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccagagcguggaccacaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuggccccccagacugaccuucggcggcggcagcaagguggagaucaag

SEQ ID NO: 35342 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccagagcgugagccacaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuggccccccagacugaccuucggcggcggcagcaagguggagaucaag

SEQ ID NO: 35343 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccagagcgugagccacaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuucccccccagacugaccuucggcggcggcagcaagguggagaucaag

SEQ ID NO: 35344 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccagagcguggacagcaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuucccccccagacugaccuucggcggcggcagcaagguggagaucaag

SEQ ID NO: 35345 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccagagcguggacagcaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuacccccccagacugaccuucggcggcggcagcaagguggagaucaag

SEQ ID NO: 35346 - RNA, 327 nt, Artificial Sequence
  derived and/or modified sequence opt4 from anti-influenza_Chain
gagaccacccugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagagcgaggacuucgccguguacuacugccagcacuacagcaacuggccccccagacugaccuucggcggcggcaccaagguggagaucaag

SEQ ID NO: 35347 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagagcgaggacuucgccguguacuacugccagcacuacagcaacuggccccccagacugaccuucggcggcggcaccaagguggagaucaag

SEQ ID NO: 35348 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagcccgaggacuucgccguguacuacugccagcacuacagcaacuggccccccagacugaccuucggcggcggcaccaagguggagaucaag

SEQ ID NO: 35349 - RNA, 327 nt, Artificial Sequence
  derived and/or modified sequence opt4 from anti-influenza_Chain
gagaucgugaugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagagcgaggacuucgccguguacuacugccagcacuacagcaacuggccccccagacugaccuucggcggcggcaccaagguggagaucaag

SEQ ID NO: 35350 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagagcgaggacuucgccguguacuacugccagcacuacagcaacuucccccccagacugaccuucggcggcggcaccaagguggagaucaag

SEQ ID NO: 35351 - RNA, 327 nt, Artificial Sequence
  derived and/or modified sequence opt4 from anti-influenza_Chain
gagaucgugcugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagagcgaggacuucgccguguacuacugccagcacuacagcaacuacccccccagacugaccuucggcggcggcaccaagguggagaucaag

SEQ ID NO: 35352 - RNA, 327 nt, Artificial Sequence
  derived and/or modified sequence opt4 from anti-influenza_Chain
gagaucgugcugacccagagccccgccacccugagcgugagccccggcgagagagugacccugagcugcagagccagccagagcguggccaacaaccuggccugguaccagcagaagcccggccagagccccagacugcugaucuacggcgccagcaccagagacaccggcauccccgccagauucagcggcagcggcagcggcaccgaguucacccugaccaucagcagccugcagagcgaggacuucgccguguacuacugccagcaguacaacaacuggccccccauguacaccuucggccagggcaccaagcuggagaucaag

SEQ ID NO: 35353 - RNA, 327 nt, Artificial Sequence
  derived and/or modified sequence opt4 from anti-influenza_Chain
gacaucgugaugacccagagccccagcacccugagcgccagcgugggcgacagagugaccaucaccugcagagccagccagagcaucggcaacuggcuggccugguaccagcagaagcccggcaaggcccccaagcugcugaucuacaaggugagcacccuggagagcggcgugcccagcagauucagcggcagcggcagcggcaccgaguucacccugaccaucaacagccugcagcccgacgacuucgccaccuacuacugccagagauacaccagcaacagccagggcuucaccuucggccagggcaccaagcuggagaucaag

SEQ ID NO: 35354 - RNA, 327 nt, Artificial Sequence
  derived and/or modified sequence opt4 from anti-influenza_Chain
gacaucgugaugacccagagccccgccacccugagcgugagccccggcgagagagccacccugagcugcagagccagccagguggugggcaccaaccuggccugguaccagcagaagcccggccaggcccccagacugcugaucuacgccgccagcaccagagccaccggcauccccgccagauucagcggcagcggcuucggcaccgacuucacccugaccaucagcagccugcagagcgaggacuucgccguguacuacugccagcaguacaacaacuggccccugagcuucggcggcggcaccaagguggagaucagaagaacc

SEQ ID NO: 35355 - RNA, 327 nt, Artificial Sequence
  derived and/or modified sequence opt4 from anti-influenza_Chain
gacauccagaugacccagagccccagcagccugagcgccagcgugggcgacagagugaccaucgugugcagagccagccagggcaucaacacccaccugcacugguaccagcagaagcccggcaaggcccccaagcugcugaucuacagcgccagcacccugcacaccggcgugcccagcagacugagcggcagcggcagcggcaccgacuucacccugagcaucagcagccugcagcccgaggacuucgccaccuacuacugccagcagagcuacaacuaccccagaaccuucggccagggcaccaacguggacaucaagagaacc

SEQ ID NO: 35356 - RNA, 327 nt, Artificial Sequence
  derived and/or modified sequence opt4 from anti-influenza_Chain
gacauccugaugacccagagccccagcagccugagcgccagcgugggcgacagagugaccaucaccugcagagccagccaggacaucagaaacagacuggccugguaccagcagaagcccggcaaggcccccaagagacugaucuacgccgccagcagccugcagagcggcgugcccagcagauucagcggcagcggcagcggcaccgaguucacccugaccaucaacagccugcagcccgaggacuucgccaccuacuacugccugcagcacaacagcuaccccuggaccuucggccccggcaccaagguggagaucaagagaacc

SEQ ID NO: 35357 - RNA, 327 nt, Artificial Sequence
  derived and/or modified sequence opt4 from anti-influenza_Chain
gacaucgugaugacccagagccccgccacccugagcgugagccccggcgagggcgccacccugagcugcagagccagccagggcaucggcagcaaccuggccugguaccagcacaagcccggccaggcccccagacugcugaucuacgccgccagcaccagagccaccggcgugcccgccagauucagcggcagcggcagcggcaccgaguucacccugaccaucagcagccugcagagcgaggaccuggccguguacuucugccagcaguacaacaccuggccccugaccuucggcggcggcaccaagguggagaucaucagaacc

SEQ ID NO: 35358 - RNA, 327 nt, Artificial Sequence
  derived and/or modified sequence opt4 from anti-influenza_Chain
gacaucgugaugacccagagccccagcacccugagcgccagcgugggcgacagagugaccaucaccugcagagccagccagaccaucuacagauggcuggccugguaccagcagaagcccggcaaggcccccaaggugcugaucuacaaggccagcacccuggagagcggcgugcccagcagauucagcggcagcggcagcggcaccgaguucacccuggccaucagcagccugcagcccgacgacuucgccaccuacuacugccagcaguacaacagcuuccccuacagauucggccagggcaccaagguggagaucaagagaacc

SEQ ID NO: 35359 - RNA, 327 nt, Artificial Sequence
  derived and/or modified sequence opt4 from anti-influenza_Chain
gacaucgugaugacccagagccccagcagccugagcgccagcgugggcgacagagugagcaucaccugcagagccagccagaccaucaccagauuccugaacugguaccagcagaagcccggcaagggccccaagcugcugaucuacgccgccagcaccgugcacagaggcgugcccagcagauucagcggcagcggcagcggcaccgacuucacccugaccaucagcagccugcagcccgaggacuucgccaccuacuacugccagcagagcuacagcgcccccuucaccuucggccccggcaccaccguggacaucagaagaacc

SEQ ID NO: 35360 - RNA, 327 nt, Artificial Sequence
  derived and/or modified sequence opt4 from anti-influenza_Chain
gacaucgugaugacccagccccccgccacccugagcgugagccccggcgagagagccacccugagcugcggcgccagccagggccugggcagcaaccuggccugguaccagcagaagcccggccaggcccccagacugcugaucuacgccgccagcaccagagccaccggcaucaccgccagauucagcggcagcggcagcggcaccgaguucacccugaccaucaacagccugcagagcgaggacuucgcccuguacuacugccagcaguacaccuacuggccccugaccuucggcggcggcaccaagguggagaucaagagaacc

SEQ ID NO: 35361 - RNA, 327 nt, Artificial Sequence
  derived and/or modified sequence opt4 from anti-influenza_Chain
gacaucgugcugacccagagccccgccacccugagcgugagccccggcgagagagccacccugagcugcagagccagccagagcgugaacagaaaccuggccugguuccagcagauccccggccaggcccccagacugcugaucuucgacgccagcaccagagccgccgacauccccgccagauucagcggcggcggcagcggcgccgaguucacccugaccgugagcagccugcagcccgaggacuucgccguguacuacugccagcaguacgacaaguggccccccggcuucggccagggcaccaagguggagaucaagagaacc

SEQ ID NO: 35362 - RNA, 330 nt, Artificial Sequence
  derived and/or modified sequence opt4 from anti-influenza_Chain
cagagcgugcugacccagccccccagcgccagcggcgcccccggccagagagugacccugagcugcagcggcagcggcagcaacaucggcagcaacaccgugagcugguaccagcagcugcccggcaccgcccccaagcugcugguguucaccaacaaccagagacccagcggcgugcccgacagauucagcggcagcaagagcggcaccagcgccagccuggccaucagcggccugcagagcgaggacgaggccgacuacuacugcgccgccugggacgacagccugaacggccagcuguucggcggcggcaccaagcugaccgugcug

SEQ ID NO: 35363 - RNA, 330 nt, Artificial Sequence
  derived and/or modified sequence opt4 from anti-influenza_Chain
cagagcgugcugacccagccccccagcgugagcgccgcccccggccagagagugaccaucagcugcagcggcaccagcagcaacaucggcaagaacuacgugagcugguaccagcagcugcccggcgccgcccccaagcugcugaucuacgacaacgacaagagacccagcggcauccccgacagauucagcggcagcaagagcggcaccagcgccacccugggcaucaccggccugcagaccggcgacgaggccgacuacuacugcggcaccugggacagcagccugagcgugggcauguucggcggcggcaccagacugaccgugcug

SEQ ID NO: 35364 - RNA, 330 nt, Artificial Sequence
  derived and/or modified sequence opt4 from anti-influenza_Chain
gagaccacccugacccagagccccgccacccugagcgugagccccggcgagagagccacccugagcugcagagccagccagagcgugagcagaaaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagcagcaucaccuucggccagggcaccagacuggagaucaagagaaccgug

SEQ ID NO: 35365 - RNA, 330 nt, Artificial Sequence
  derived and/or modified sequence opt4 from anti-influenza_Chain
cagagcgugcugacccagccccccagcgccagcggcacccccggccagagagugaccaucagcugcagcggcagcagcagcaacaucggcagcaacaccgugaacugguacaagcagcugcccggcaccgcccccagacugcugaucuacagcaacgaccagagacccagcggcgugcccgacagauucagcggcagcaagagcggcaccagcgccagccuggccaucagcggccugcagagcgaggacgaggccaacuacuacugcgccgccugggacgacagccugagcggcuggguguucggcggcggcaccaagcugaccgugcug

SEQ ID NO: 35366 - RNA, 330 nt, Artificial Sequence
  derived and/or modified sequence opt4 from anti-influenza_Chain
cagagcgcccugacccagcccagaagcgugagcggcagccccggccagagcgugaccaucagcugcaccggcagcagcagcgacgugggcgccagcaacagcgugagcugguaccagcagcaccccggcaaggcccccaagcuggugaucuacgacgugaccgagagacccagcggcgugccccacagauucagcggcagcaagagcggcaacaccgccagccugaccgugagcggccugcagcccgaggacgaggccgacuacuucugcugcgccuacggcggcaaguaccuggugguguucggcggcggcaccaaggugaccgugcug

SEQ ID NO: 35367 - RNA, 330 nt, Artificial Sequence
  derived and/or modified sequence opt4 from anti-influenza_Chain
cagagcgcccugacccagcccgccagcgugagcggcagccccggccagagcaucaccaucagcugcaccggcaccagcagcgacgugggcggcuacaacuacgugagcugguaccagcagcaccccggcaaggcccccaagcugcugaucuacgaggugaccaacuggcccagcggcgugagcaacagauucagcggcagcaagagcggcaacaccgccagccugaccaucagcggccugcaggccgaggacgaggccgacuacuacugcagcagcuacgccggcagcagcaccuggguguucggcggcggcaccagagugaccgugcug

SEQ ID NO: 35368 - RNA, 330 nt, Artificial Sequence
  derived and/or modified sequence opt4 from anti-influenza_Chain
cagaccguggugacccaggagcccagccugaccgugagccccggcggcaccgugacccugaccugcgccagcagcaccggcgccgugaccagcagcuacuuccccaacugguuccagcagaagcccggccaggcccccagaccccugaucuacagcaccaccaucagacacagcuggacccccgccagauucagcggcagccugcugggcggcaaggccgcccugacccugagcggcgugcagcccgaggacgaggccgacuacuacugccugcuguacagcggcggcgaccccguggccuucggcggcggcaccaagcugaccgugcug

SEQ ID NO: 35369 - RNA, 330 nt, Artificial Sequence
  derived and/or modified sequence opt4 from anti-influenza_Chain
cagagcgugcugacccagagccccagcgugagcgccgcccccggccagaaggugaccaucagcugcagcggcagcgacagcaacaucggcgacuacuucgugugcugguaccagcaccugcccggcaagcccccccagcugcugaucuacgagaacaacaagagacccagcggcauccccgacagauucagcggcagcaagagcggcaccagcgccacccugggcaucaccggcauccagaccggcgacgaggccgacuacuacugcgccaccugggacggcagccugagcgccuggguguucggcggcggcaccaagcugaccgugcug

SEQ ID NO: 35370 - RNA, 330 nt, Artificial Sequence
  derived and/or modified sequence opt4 from anti-influenza_Chain
cagagcgcccugacccagcccagaagcgugagcggcagccccggccagagcaucaccaucagcugcaccggcggcagcagcgacaucggcgccagcaacagcgugagcugguaccagcagcaccccggcaaggcccccaagcuggugaucuucgacgugaccgagagacccagcggcgugccccacagauucagcggcagcaagagcggcaacaccgccagccugaccgugagcggccugcagcccgacgacgaggccgacuacuucugcugcgccuacggcggcaaguaccuggugguguucggcggcggcaccaaggugaccgugcug

SEQ ID NO: 35371 - RNA, 330 nt, Artificial Sequence
  derived and/or modified sequence opt4 from anti-influenza_Chain
caggccguggugacccaggagcccagccuggccgugagccccggcggcaccgugacccugaccugcggcagcagcaccggcgccgugaccagaggccacuaccccuacugguuccagcagaagcccggccaggcccccagagcccugaucuacgacagcgccggcaacagacacagcuggacccccgccagauucagcggcagccugcugggcggcaaggccgcccugacccugagcggcgcccagcccgaggacgaggccgaguacuacugccugcugagcuacagcggcguguggguguucggcggcggcaccaagcugaccgugcug

SEQ ID NO: 35372 - RNA, 330 nt, Artificial Sequence
  derived and/or modified sequence opt4 from anti-influenza_Chain
gagaucgugaugacccagagccccgccacccugagcgugagccccggcgagagagugacccugagcugcagagccagccagagcaucaccgacggccuggccugguaccagcagaagagcggccaggcccccagacugcugaucuacggcgccagcaccagagccaccggcauccccgccagauucagcggcagcggcagcggcaccgaguucacccugaccaucagcagccugcagagcgaggacuucgccguguacuacugccagcaguacaacaacuggccccccgugaccuucggccagggcaccaagguggagaucaagagaacc

SEQ ID NO: 35373 - RNA, 330 nt, Artificial Sequence
  derived and/or modified sequence opt4 from anti-influenza_Chain
agcagcgagcugacccagccccccagcgccagcggcacccccggccagagagugaccaucagcugcagcggcagcaccagcaacaucggcuacaaccccgugagcugguaccagcaggugcccggcaccgcccccaagcugcugaucuacagcaacaccgagagacccagcggcgugcccgacagauucagcggcagcaagagcggcaccagcgccagccuggccaucagcggccugcagagcgaggacgaggccgacuacuacugcgccgccugggacgacacccugaacggccccguguucggcggcggcaccaaggugaccgugcug

SEQ ID NO: 35374 - RNA, 330 nt, Artificial Sequence
  derived and/or modified sequence opt4 from anti-influenza_Chain
cagagcgcccugacccagcccgccagcgugagcggcagccccggccagagcaucaccaucagcugcaccggcaccagcagcgacgugggcggcuacaacuacgugagcugguaccagcagcaccccggcgaggcccccaagcugaugaucagcgacgugagcaacagacccagcggcgugagcaacagauucagcggcagcaagagcggcaacaccgccagccugaccaucagcggccugcaggccgaggacgaggccgacuacuacugcaccagcuacaccagcagcaacacccugguguucggcggcggcaccaagcugaccgugcug

SEQ ID NO: 35375 - RNA, 330 nt, Artificial Sequence
  derived and/or modified sequence opt4 from anti-influenza_Chain
cagagcgugcugacccagccccccagcgugagcgccgcccccggccagaaggugaccaucagcugcagcggcagcagcagcaacaucggccacaacuucgugagcugguaccagcagcugcccgccaccgcccccaagcugcugaucuacgacaccgacaagagacccagcggcauccccgacagauucagcggcagcaagagcggcaccagcgccacccugggcaucaccggccugcagaccggcgacgaggccgacuacuacugcggcaccugggacagcagccugagcagcgugaucuucggcggcggcaccaagcugaccgugcug

SEQ ID NO: 35376 - RNA, 330 nt, Artificial Sequence
  derived and/or modified sequence opt4 from anti-influenza_Chain
gacauccagaugacccagagccccagcacccugagcgccagcgugggcgacagagugaccaucaccugcagagccagccagaccaucaacaacuaccuggccugguaccagcagaagcccggcaaggcccccaagcugcugaucuacaaggccagcagccuggagagcggcgugcccagcagauucagcggcagcggcagcggcaccgaguucacccugaccaucagcagccugcagcccgacgacuucgccaccuacuacugccaggaguacaacaacgacagcccccugaccuucggcggcggcaccaagguggagaucaagagaacc

SEQ ID NO: 35377 - RNA, 330 nt, Artificial Sequence
  derived and/or modified sequence opt4 from anti-influenza_Chain
gacaucgagcugacccaggaccccagcgugagcguggcccccggccagaccgccagaauccccugcgugagauucaacaugggccccaccagcgugcacugguaccagcagaagcccggccaggcccccgugcuggugguguacgacgacagcgacagacccagcggcauccccgagagauucagcggcagcaacagcggcgacagcgccacccugaccaucagcagaguggaggccggcgacgaggccgacuacuacugccaggugugggacaugagcagcgacagaagaguguucggcggcggcaccacccugaccgugcugggccag

SEQ ID NO: 35378 - RNA, 330 nt, Artificial Sequence
  derived and/or modified sequence opt4 from anti-influenza_Chain
gacaucgugaugacccagagccccggcacccugagccugagccccggcgagagagccacccuguacugcagagccagccagagcgugagaagcggcuaccuggccugguaccagcacaagcccggccaggccccccugcugcuguucuacgacgccagcggcagagccaccggcauccccgacagauucagcggcagcggcagcggcaccgacuucacccugaccaucagcagacuggagcccgaggacuucgccguguacuacugccugcaguacggcagcagccccagaaccuucggccagggcaccaagguggagaucaagagaacc

SEQ ID NO: 35379 - RNA, 330 nt, Artificial Sequence
  derived and/or modified sequence opt4 from anti-influenza_Chain
gacaucgugcugacccagagccccagcuuccugagcgccagcgugggcgacagagugaccaucaccugcagagccagccagcugaucagcagcuacuucgccugguaccagcagaagcccggcaagccccccaagcugcugaucuacgccgccagcacccugcagagcggcgugcccagcagauucagcggcagcggcagcggcacccaguucagccugaccaucagcagccugcagcccgaggacuucgccaccuacuacugccagcagcugaacagcuacccccccaucaccuucggccagggcaccagacuggagaucaagagaacc

SEQ ID NO: 35380 - RNA, 330 nt, Artificial Sequence
  derived and/or modified sequence opt4 from anti-influenza_Chain
gacaucacccugacccagagccccgccacccugagcgugagccccggcgagagagccacccugagcugcagagccagccagagcgugagcagcaaccuggccugguaccagcagaagcccggccaggcccccagacugcugaucuacggcgccagcaacagagccaccgacauccccgccagauucagcggcagcggcagcggcaccgaguucacccugaccaucagcagccugcagagcgaggacuucgccguguacuacugccagcaguucaacgacuggcccuuccugaccuucggcggcggcaccaagguggagaucaagagaacc

SEQ ID NO: 35381 - RNA, 330 nt, Artificial Sequence
  derived and/or modified sequence opt4 from anti-influenza_Chain
gacaucgugaugacccagagccccagcuuccugagcgccagcgugggcgacagagugaccaucaccugcagaaccagccaggugaucagcagcuaccuggccugguaccagcagagacccggcaaggcccccaagcugcugaucuacgccgccagcacccugcagagcggcgugcccagcagauucagcggcagcggcagcggcaccagauucagccugaccaucagcaaccugcagcccgaggacuucgccaccuacuucugccagcagcugaccaccuacccccccaucaccuucggccagggcaccagacuggagaucaagagaacc

SEQ ID NO: 35382 - RNA, 330 nt, Artificial Sequence
  derived and/or modified sequence opt4 from anti-influenza_Chain
gacaucgugcugacccagagccccagcgugagcguggcccccggccagaccgccagaaucaccugcggcggcaacgacaucggcagcaagagcgugcacugguaccagcagaagcccggccaggcccccgugcuggugguguucgacgacagagacagacccagcggcauccccgagagauucagcggcagcaacagcggcaacaccgccacccugaccaucagcagaguggaggccggcgacgaggccgacuacuacugccaggugugggacaucaccagcgaccuggugguguucggcggcggcaccaagcugaccguggugggccag

SEQ ID NO: 35383 - RNA, 330 nt, Artificial Sequence
  derived and/or modified sequence opt4 from anti-influenza_Chain
gacaucgugaugacccagccccccggcacccugagcgugagccccggcgagagagccacccugagcugcagagccagccagagcgugagcaccaaccuggccugguaccagcagaagcccggccaggcccccagacugcugauccacggcgccagcaccagagccaccggcauccccgccagauucagcggcagcggcagcggcgccgaguucacccugaccaucagcagccugcagagcgaggacguggccguguacuacugccagcaguacgacaacuggcugcccaucaccuucggccccggcaccaagguggacauccagagaacc

SEQ ID NO: 35384 - RNA, 330 nt, Artificial Sequence
  derived and/or modified sequence opt4 from anti-influenza_Chain
gaccccaugcugacccagaccgccagccccgugagcgccgccgugggcggcaccgugaccaucaacugccaggccagccagagcguguacaacaagaacaaccuggccugguaccagcagaagcugggccagccccccaagcugcugaucuacgccgccagcacccugaccagcggcgugcccagcagauucaagggcagcggcagcggcacccaguucacccugaccaucagcgaccuggagugcgacgacgccgccaccuacuacugcgccggcgacuacagcggcggcaucuacgccuucggcggcggcaccaagguggagaucaag

SEQ ID NO: 35385 - RNA, 330 nt, Artificial Sequence
  derived and/or modified sequence opt4 from anti-influenza_Chain
gagcuggugaugacccagacccccgccagcgugagcgccgccgugggcggcaccgugaccaucagcugccagagcagcgagagcguguacaagaacaacaaccuggccugguuccagcagaagcugggccagccccccaagcugcugaucuacgacgccagcaagcuggccagcggcgugcccagcagauucagcggcagcggcagcggcacccaguucacccugaccaucagcgaccuggagugcgacgacgccgccaccuacuacugcgccggcgacuacagcggcagcaacuacgccuucggcggcggcaccaagcuggagaucaag

SEQ ID NO: 35386 - RNA, 330 nt, Artificial Sequence
  derived and/or modified sequence opt4 from anti-influenza_Chain
gagcccaugcugacccagaccgccagcagcgugagcgccgccgugggcggcagcgugaccaucagcugccagagcagccagagcguggacagcaacaaccagcugagcugguaccagcagaagcccggccagccccccaagcugcugaucuacgccgccagcacccugaccagcggcgugcccagcagauucaagggcagcggcagcggcacccaguucacccugaccaucagcgaccuggagugcgacgacgccgccaccuacuacugcgccggcgacuacagcggcggcaucuacgccuucggcggcggcaccgaggugguggugaag

SEQ ID NO: 35387 - RNA, 330 nt, Artificial Sequence
  derived and/or modified sequence opt4 from anti-influenza_Chain
gaccccaugcugacccagaccgccgccagcgugagcgccgccgugggcggcaccgugaccaucagcugccagagcagcgagagcguguacaagaacaacaaccuggccugguuccagcagaagcugggccagccccccacccugcugaucugggacgccagcaagcuggccagcggcgugcccagcagauucagcggcagcggcagcggcacccaguucacccugaccaucagcgaccuggagugcgacgacgccgccaccuacuacugcgccggcgacuacagcggcgugaacuacgccuucggcggcggcaccgaggugguggugaag

SEQ ID NO: 35388 - RNA, 330 nt, Artificial Sequence
  derived and/or modified sequence opt4 from anti-influenza_Chain
gagcuggugaugacccagacccccgccagcgugagcgccgccgugggcggcaccgugaccaucagcugccagagcagcgagagcguguacaagaacaacaaccuggccugguuccagcagaagcugggccagccccccaagcugcugaucuacgacgccagcaagcuggccagcggcgugcccagcagauucagcggcagcggcagcggcacccaguucacccugaccaucagcgaccuggagugcgacgacgccgccaccuacuacugcgccggcgacuacagcggcagcaacuacgccuucggcggcggcaccgaggugguggugaag

SEQ ID NO: 35389 - RNA, 330 nt, Artificial Sequence
  derived and/or modified sequence opt4 from anti-influenza_Chain
gaccccaugcugacccagaccgccagcagcgugagcgccaccgugggcggcaccgugaccaucagcugccagagcagccagagcguggacaacaacaaggaccuggccugguuccagcagaagcccggccacagccccaagcugcugaucuacuucgccagcagacuggccagcggcgugcccagcagauucaagggcagcggcagcggcacccacuucacccugaccaucagcgaccuggagugcgacgacgccgccaccuacuacugcgccggcgacuacagcggcgccaacuacgccuucggcggcggcaccaagcuggagaucaag

SEQ ID NO: 35390 - RNA, 330 nt, Artificial Sequence
  derived and/or modified sequence opt4 from anti-influenza_Chain
gaccccaugcugacccagaccgccagccccgugagcgccgccgugggcggcaccgugaccaucaacugccagagcagccagagcguguacaacaacaacagacugagcugguuccagcagaagcccggccagccccccaagcugcugaucuacagcgccagcacccuggccagcggcgugagcagcagauucaagggcagcggcagcggcacccaguucacccugaccaucagcgaccuggagugcgacgacgccgccaccuacuacugcgccggcgacuacagcggcggcaucuacgccuucggcggcggcaccgagcuggagauccug

SEQ ID NO: 35391 - RNA, 330 nt, Artificial Sequence
  derived and/or modified sequence opt4 from anti-influenza_Chain
gagcuggugcugacccagacccccgccagcgugagcgccgccgugggcggcaccgugagcaucagcugccagagcagccagagcguguacaagaacaacaaccuggccugguuccagcagaagcugggccagccccccacccugcugaucugggacgccagcaagcuggccagcggcgugcccagcagauucagcggcagcggcagcggcacccaguucacccugaccaucagcgaccuggagugcgacgacgccgccaccuacuacugcgccggcgacuacagcggcgugaacuacgccuucggcggcggcaccaagcuggagaucaag

SEQ ID NO: 35392 - RNA, 330 nt, Artificial Sequence
  derived and/or modified sequence opt4 from anti-influenza_Chain
gagcuggaccugacccagacccccgccagcgugagcgccgccgugggcggcaccgugaccaucagcugccagagcagcgagagcguguacaagaacaacaaccuggccugguuccagcagaagcugggccagccccccacccugcugaucugggacgccagcaagcuggccagcggcgugcccagcagauucagcggcagcggcagcggcacccaguucacccugaccaucagcgaccuggagugcgacgacgccgccaccuacuacugcgccggcgacuacagcggcgugaacuacgccuucggcggcggcaccgaggugguggugaag

SEQ ID NO: 35393 - RNA, 330 nt, Artificial Sequence
  derived and/or modified sequence opt4 from anti-influenza_Chain
gacauccagaugacccagagccccagcagccugagcgccagcgugggcgacagagugaccaucaccugccagagcagcgagagcguguacaagaacaacaaccuggccugguaccagcagaagcccggcaagccccccaagcugcugaucugggacgccagcaagcuggccagcggcgugcccagcagauucagcggcagcggcagcggcaccgacuucacccugaccaucagcagccugcagcccgaggacguggccaccuacuacugcgccggcgacuacagcggcgugaacuacgccuucggcggcggcaccgaggugguggugaag

SEQ ID NO: 35394 - RNA, 333 nt, Artificial Sequence
  derived and/or modified sequence opt4 from anti-influenza_Chain
gacaucgugaugacccagagccccgacagccuggccgugagccugggcgagagagccaccaucaacugcaagagcagccagagcgugaccuucaacaacaagaacuaccuggccugguaccagcagaagcccggccagccccccaagcugcugaucuacugggccagcaccagagagagcggcgugcccgacagauucagcggcagcggcagcggcaccgacuucacccugaccaucagcagccugcaggccgaggacguggccguguacuacugccagcagcacuacagaaccccccccaccuucggccagggcaccaagguggagaucaag

SEQ ID NO: 35395 - RNA, 333 nt, Artificial Sequence
  derived and/or modified sequence opt4 from anti-influenza_Chain
cagagcgcccugacccagcccgccagcgugagcggcagccccggccagagcaucaccaucagcugcaccggcaccggcagcgacgugggcagcagcaaccuggugagcugguaccagcagcaccccgccaaggcccccaagcugaucaucuacgaggugaccaagagacccagcggcgugagcaacagauucagcggcagcaagagcggcaacaccgccagccugaccaucagcggccugcaggccgaggacgaggccgacuacuacugcugcagcuacgccggcagcagcagcagcagaguguucggcaccggcaccaaggugaccgugcug

SEQ ID NO: 35396 - RNA, 333 nt, Artificial Sequence
  derived and/or modified sequence opt4 from anti-influenza_Chain
cagagcgugcugacccagccccccagcgccagcggcacccccggccagagagugaccaucagcugcagcggcagcaccagcaacaucggcagcaacgccgugaacugguaccagcagcugcccggcaccgcccccaagcugcugaucuacagcaacaaccagagacccagcggcgugcccgacagauucagcggcagcaagagcggcaccagcgccagccuggccaucagcggccugcagagcgaggacgaggccgacuacuacugcgccgccugggacgacagccugagcggcagcuggguguucggcggcggcaccaagcugaccgugcug

SEQ ID NO: 35397 - RNA, 333 nt, Artificial Sequence
  derived and/or modified sequence opt4 from anti-influenza_Chain
gagaccacccugacccagagccccggcacccugagccugagccccggcgagagagccacccugagcugcagagugagccagagcgugagcagcaacuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcaccagccccagagccuucggccacggcaccaagguggagaucaagagaaccgug

SEQ ID NO: 35398 - RNA, 333 nt, Artificial Sequence
  derived and/or modified sequence opt4 from anti-influenza_Chain
cagagcgugcugacccagccccccagcgugagcggcgcccccggccagagagugaccaucagcugcggcggcagcagaagcaacaucggcgccggcuacgacgugcacugguaccagcaguuccccggcaccgcccccaagguggugaucuacggcaacaacaacagacccagcggcgugcccgacagauucagcggcagcaagagcggcaccagcgccagccuggccaucaccggccugcaggccgaggacgaggccaacuacuacugccagagcuacgacaccaaccugggcggcagcaucuucggcggcggcacccaggugaccgugcug

SEQ ID NO: 35399 - RNA, 333 nt, Artificial Sequence
  derived and/or modified sequence opt4 from anti-influenza_Chain
aacuucaugcugacccagccccacagcgugagcgagagccccggcaagaccgugaccaucagcugcaccggcagcagcggcagcaucgccagcaacuacgugcagugguaccagcagagacccggcagcgcccccaccaccgugaucuacgaggacuaccagagacccagcggcgugcccgacagauucagcggcagcaucgacagcagcagcaacagcgccagccugaccaucagcggccugaagaccgaggacgaggccgacuacuacugccagagcuacgacgacagcgaccaccugaucuucggcggcggcaccaagcugaccgugcug

SEQ ID NO: 35400 - RNA, 333 nt, Artificial Sequence
  derived and/or modified sequence opt4 from anti-influenza_Chain
cagagcaugcugacccagccccccagcgccagcggcacccccggccagagagugaccaucagcugcagcggcagcagcagcaacaucggcagcaacaccgugaacugguucaagcaccugcccggcaccgcccccaagcugcugaucuacagaaacgaccugagacccagcggcgugcccgacagauucagcggcagcaagagcggcaccagcgccagccuggccaucagcggccugcagagcgaggacgaggccgacuacuacugcgccaccugggacgacagccugaacggcuucuacguguucggcaccggcaccaaggugaccgugcug

SEQ ID NO: 35401 - RNA, 333 nt, Artificial Sequence
  derived and/or modified sequence opt4 from anti-influenza_Chain
gacauccagcugacccagagccccagcagccugagcgccagcgccggcgacagagugagcaugaccugcagagccagccagaucaucagcagcagccugaacugguaccagcagaagcccggcaaggcccccaagcugcugaucuacgccgccagcaaccugcagagcggcgugcccagcagauucagcggcagcggcagcggcaccgacuucacccugaccaucagcagccugcagcccgaggacuucgccaccuacuacugccagcagagcuacagcaccccccccgagcugaccuucggcggcggcaccaagguggacaucaagagaacc

SEQ ID NO: 35402 - RNA, 333 nt, Artificial Sequence
  derived and/or modified sequence opt4 from anti-influenza_Chain
agcuacgugcugacccagccccccagcgccagcggcacccccggccagagagugaccaucagcugcagcggcagcaccuucaacaucggcagcaacgccguggacugguacagacagcugcccggcaccgcccccaagcugcugaucuacagcaacaaccagagacccagcggcgugcccgacagauucagcggcagcagaagcggcaccagcgccagccuggccaucagcggccugcagagcgaggacgaggccgacuacuacugcgccgccugggacgacauccugaacgugcccguguucggcggcggcaccaagcugaccgugcugggc

SEQ ID NO: 35403 - RNA, 333 nt, Artificial Sequence
  derived and/or modified sequence opt4 from anti-influenza_Chain
cagagcgcccugacccagcccgccgccgugagcggcagccccggccagagcaucaccaucagcugcaccggcaccagcagcgacgugggcggcuacaacuacgugagcugguaccagcagcaccccggcaaggcccccaagcugaugaucuacgaggugagcaacagacccagcggcgugagcaacagauucagcggcagcaagagcggcaacaccgccagccugaccaucagcggccugcaggccgaggacgaggccgacuacuacugcagcagcuacaccagcagcagcaccuacguguucggcaccggcaccaaggugaccgugcugggc

SEQ ID NO: 35404 - RNA, 333 nt, Artificial Sequence
  derived and/or modified sequence opt4 from anti-influenza_Chain
agcuacgugcugacccagccccccagcgugagcggcacccccggccagagagugaccaucagcugcagcggcagcagaagcaacgugggcgacaacagcguguacugguaccagcacgugcccgagauggcccccaagcugcugguguacaagaacacccagagacccagcggcgugcccgccagauucagcggcagcaagagcggcaccagcgccagccuggccaucaucggccugcagagcggcgacgaggccgacuacuacugcguggccugggacgacagcguggacggcuacguguucggcagcggcaccaaggugaccgugcugggc

SEQ ID NO: 35405 - RNA, 333 nt, Artificial Sequence
  derived and/or modified sequence opt4 from anti-influenza_Chain
agcgugcugacccagccccccagcgugagcgccgcccccggccagaaggugaccaucagcugcagcggcagcagcagcaacaucggcaacgacuacgugagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccaacuacuacugcgccaccugggacagaagacccaccgccuacgugguguucggcggcggcaccaagcugaccgugcugggc

SEQ ID NO: 35406 - RNA, 333 nt, Artificial Sequence
  derived and/or modified sequence opt4 from anti-influenza_Chain
cagagcgcccugacccagcccagaagcgugagcggcagccccggccagagcgugaccaucagcugcaccggcaccagcagcgacgugggcggcuacaacuacgugagcugguaccagcagcaccccggcaaggcccccaagcugaugaucuacgacgugagcaagagacccagcggcgugcccgacagauucagcggcagcaagagcggcaacaccgccagccugaccaucagcggccugcaggccgaggacgaggccgacuacuacugcagcagcuacaccagcagcagcacccacguguucggcaccggcaccaaggugaccgugcugggc

SEQ ID NO: 35407 - RNA, 333 nt, Artificial Sequence
  derived and/or modified sequence opt4 from anti-influenza_Chain
agcuacgugcugacccagccccccagcgccagcggcacccccggccagagagugaccaucagcugcagcggcagcagcagcaacaucggcagcaacuacguguacugguaccagcagcugcccggcaccgcccccaagcugcugaucuacagagacggccagagacccagcggcgugcccgacagauucagcggcagcaagagcggcaccagcgccagccuggccaucagcggccugagaagcgacgacgaggccgacuacuacugcgccaccugggacgacaaccugagcggccccguguucggcggcggcaccaagcugaccgugcugggc

SEQ ID NO: 35408 - RNA, 333 nt, Artificial Sequence
  derived and/or modified sequence opt4 from anti-influenza_Chain
cagagcgcccugacccagcccgccagcgugagcggcagccccggccagagcaucaccaucagcugcaccggcaccagcagcgacgugggcggcuacaacuacgugagcugguaccagcagcaccccggcaaggcccccaagcugaugaucuacgaggugagcaacagacccagcggcgugagcaacagauucagcggcagcaagagcggcaacaccgccagccugaccaucagcggccugcaggccgaggacgaggccgacuacuacugcagcagcuacaccagcagcagcacccugguguucggcaccggcaccaaggugaccgugcugggc

SEQ ID NO: 35409 - RNA, 333 nt, Artificial Sequence
  derived and/or modified sequence opt4 from anti-influenza_Chain
accgugcugacccagccccccagcgugagcggcgcccccggccagagagugaccaucagcugcaccggcagcagcagcaacaucggcgccggcuacgacgugcacugguaccagcagcugcccggcaccgcccccaagcugcugaucuacggcaacagcaacagacccagcggcgugcccgacagauucagcggcagcaagagcggcaccagcgccacccugggcaucaccggccugcagaccggcgacgaggccgacuacuacugcggcaccugggacagcagccugagcgccuacguguucggcaccggcaccaaggugaccgugcugggc

SEQ ID NO: 35410 - RNA, 333 nt, Artificial Sequence
  derived and/or modified sequence opt4 from anti-influenza_Chain
ggcagcgcccugacccagcccagaagcgugagcggcagccccggccagagcgugaccaucagcugcaccggcaccagcagcgacgugggcggcuacaacuacgugagcugguaccagcagcaccccggcaaggcccccaagcugaugaucuacgacgugagcaagagacccagcggcgugcccgacagauucagcggcagcaagagcggcaacaccgccagccugaccaucagcggccugcaggccgaggacgaggccgacuacuacugcagcagcuacaccagcagcagcacccacguguucggcaccggcaccaaggugaccgugcugggc

SEQ ID NO: 35411 - RNA, 333 nt, Artificial Sequence
  derived and/or modified sequence opt4 from anti-influenza_Chain
gagaucgugcugacccagagccccggcacccugagccugagccccggcgagagagccacccugagcugcagagccagccagagcgugagcagcagcuaccuggccugguaccagcagaagcccggccaggcccccagacugcugaucuucggcgccagcaccagagccaccggcauccccgacagauucagcggcagcggcagcggcaccgacuucacccugaccaucagcagacuggagcccgaggacuucgccguguucuacugccagcaguacggcagccugccccugaccuucggcggcggcaccaagguggagaucaagggcaccgug

SEQ ID NO: 35412 - RNA, 333 nt, Artificial Sequence
  derived and/or modified sequence opt4 from anti-influenza_Chain
gagaucgugcugacccagagccccggcacccugagccugagccccggcgagagagccacccugagcugcagagccagccagagcgugagaagcaacaaccuggccugguaccagcacaagcccggccaggcccccagacugcugaucuucggcgccagcagcagagccaccggcauccccgacagauucagcggcagcggcagcggcaccgacuucacccugaccaucagcagacuggagcccgaggacuucgccguguacuacugccagcaguacggcagcagccccgcccugaccuucggcggcggcaccaagguggagaucaagagaacc

SEQ ID NO: 35413 - RNA, 333 nt, Artificial Sequence
  derived and/or modified sequence opt4 from anti-influenza_Chain
cagagccuggaggagagcggcggcggccuggugaagcccggcggcagccugacccugaccugcaccgugagcggccugagccuguacagcaacgagaucaacugggugagacaggcccccggcaacggccuggaguggaucggcgccaucgccggcagcggcagcgccgacuacgccagcugggccaagggcagaagcaccaucaccagaaacaccgaccugaacaccgugacccugaagaugaccagccugaccgccgccgacaccgccaccuacuucugcgccagcuucugggaccuguggggccccggcacccuggugaccgugagcagc

SEQ ID NO: 35414 - RNA, 333 nt, Artificial Sequence
  derived and/or modified sequence opt4 from anti-influenza_Chain
cagagcguggaggagagcggcggcggccuggugaagcccggcggcagccugacccugaccugcaccgugagcggccugagccuguacagcaacgagaucaacugggugagacaggcccccggcaacggccuggaguggaucggcgccaucgccggcagcggcagcgccgacuacgccagcugggccaagagcagaagcaccaucaccagaaacaccaaccugaacaccgugacccugaagaugaccagccugaccgccgccgacaccgccaccuacuucugcgccagcuucugggaccuguggggccccggcacccuggugaccgugagcagc

SEQ ID NO: 35415 - RNA, 333 nt, Artificial Sequence
  derived and/or modified sequence opt4 from anti-influenza_Chain
cagagccuggaggagagcggcggcggccuggugaagcccggcggcagccugacccugaccugcaccgugagcggccugagccuguacagcaacgagaucaacugggugagacaggcccccggcaacggccuggaguggaucggcgccaucgccggcagcggcagcgccgacuacgccagcugggccaagagcagaagcaccaucaccagaaacaccaaccugaacaccgugacccugaagaugaccagccugaccgccgccgacaccgccaccuacuucugcgccagcuucugggaccuguggggccccggcacccuggugaccgugagcagc

SEQ ID NO: 35416 - RNA, 333 nt, Artificial Sequence
  derived and/or modified sequence opt4 from anti-influenza_Chain
aacaucgugcugacccagagccccgccagccuggccgugagccugggccagagagccaccaucagcugcagagccagcgagagcguggacaucuacggcaacagcuucaugcacugguaccagcagaagcccggccagccccccaagcugcugaucuaccuggccagcaagcuggagugcggcgugugcgccagauucaacggcagcggcugcagaaccgacuucacccuggccaucgaccccguggagggcgacgacggcgccaccuacuacugccagcagaacuacgaggaccccuggaccuucggcggcggcaccaagcuggagaucaag

SEQ ID NO: 35417 - RNA, 333 nt, Artificial Sequence
  derived and/or modified sequence opt4 from anti-influenza_Chain
aacaucgugcugacccagagccccgccagccuggccgugagccccggccagagagccaccaucagcugcagagccagcgagagcaucgacaucuacggcaacagcuucaugcacugguaccagaagaagcccggccagccccccaagcugcugaucuacagagccagcaaccuggagagcggcgugcccgccagauucaacggcagcggcagcagaaccgacuucacccugaccaucgaccccguggagggcgacgacggcgccaccuacuacugccagcagaacuacgaggaccccuggaccuucggcggcggcaccaagcuggagaucaag

SEQ ID NO: 35418 - RNA, 333 nt, Artificial Sequence
  derived and/or modified sequence opt4 from anti-influenza_Chain
gagaucgugcugacccagagccccgccacccugagccuguaccccggcgagagagccacccugagcugcagagccagccagagcgugagcagauaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcugaagaucaccuucggccagggcaccagacuggagaucaagggcaccgug

SEQ ID NO: 35419 - RNA, 336 nt, Artificial Sequence
  derived and/or modified sequence opt4 from anti-influenza_Chain
gacaucgugaugacccagagccccgacagccuggccgugagccugggcgagagagccaccaucaacugcaagagcagccagagcgugcuguacagcagcaacaacaagaacuaccuggccugguaccagcagaagcccggccagccccccaagcugcugaucgacugggccagcaccagagagagcggcgugcccgacagauucagcggcagcggcagcggcaccgacuucacccugaccaucagcaaccugcagguggaggacguggccguguacuacugccagcaguacuacagaagccccagcuucggccagggcaccaagcuggagaucaag

SEQ ID NO: 35420 - RNA, 336 nt, Artificial Sequence
  derived and/or modified sequence opt4 from anti-influenza_Chain
gacaucgugaugacccagaccccccugagccugagcgugacccccggccagcccgccagcaucagcugcaagagcagccagagccugcugcacagcgacggcaagaccuaccuguacugguaccugcagaagcccggccagagcccccagcugcugaucuacgaggugagcaacagauucagcggcgugcccgacagauucagcggcagcggcagcggcaccgacuucacccugaagaucagcagaguggaggccgaggacgugggcguguacuacugcaugcagaacauccugcugccccugaccuucggcggcggcaccaagguggagaucaag

SEQ ID NO: 35421 - RNA, 336 nt, Artificial Sequence
  derived and/or modified sequence opt4 from anti-influenza_Chain
gagaucgugaugacccagaccccccugagccugagcgugacccccggccagcccgccagcaucagcugcagaagcagccagagccugcugcacagcgacggcaagaccuaccuguacugguaccugcagaagcccggccagcccccccagcugcugaucagcgagguguucaacagauucagcggcgugcccgacagauucagcggcagcggcagcggcaccgacuucacccugaagaucagcagaguggaggccgaggacgugggcguguacuacugcaugcagagccugcagcugccccugaccuucggcggcggcaccaagguggagaucaag

SEQ ID NO: 35422 - RNA, 336 nt, Artificial Sequence
  derived and/or modified sequence opt4 from anti-influenza_Chain
gacaucgugaugacccagagcccccugagccugcccgugacccccggcgagcccgccagcaucagcugcagagccagccagagccugcugcacagcaacggcuacaacuaccuggacugguaccugcagaagcccggccagagcccccagcugcugauccagcugggcagcaccagagccagcggcgugcccgacagauucagcggcagcggcagcggcaccgacuucacccuggagaucagcagaguggaggccgaggacgugggcguguacuacugcaugcaggcccugcagcugccccuggccuucggccagggcaccagacuggagaucaag

SEQ ID NO: 35423 - RNA, 336 nt, Artificial Sequence
  derived and/or modified sequence opt4 from anti-influenza_Chain
gacaucgugaugacccagagcccccugagccugcccgugagccccggcgagcccgccagcaucagcugcagaagcagccagagccugcugcacggcaacggcuacaacuaccuggacugguaccugcagaagcccggccagagccccagacugcugaucuaccugggcagcaacagagccagcggcgugcccgacagauucagcggcagcggcagcggcaccgacuucacccugaagaucagcagaguggaggccgaggacgugggcguguacuacugcaugcaggcccugcagaccccccugaccuucggcggcggcaccaagguggagaucaag

SEQ ID NO: 35424 - RNA, 336 nt, Artificial Sequence
  derived and/or modified sequence opt4 from anti-influenza_Chain
cagagcgugcugacccagccccccagcgugagcggcgcccccggccagagagugaccaucagcugcaccggcagcagcagcaacaucggcgccggcuacgacgugcacugguaccagcagcugcccggcaccgcccccaagcugcugaucuacgacaacaacaacagacccagcggcgugcccgacagauucagcggcagcaagagcggcgccagcgccagccuggccaucaccggccugcaggccgaggacgaggcccacuacuacugccagagcuacgacaacagccugagcggcagcguguucggcggcggcacccagcugaccgugcugagc

SEQ ID NO: 35425 - RNA, 336 nt, Artificial Sequence
  derived and/or modified sequence opt4 from anti-influenza_Chain
cagagcgugcugacccagccccccagcgugagcggcgcccccggccagagagugaccaucagcugcaccggcagcagcagcaacaucggcagcgacuacgacgugcacugguacaagcagcugcccggcaccgcccccaagcugcugaucuucggcaacagcaacagacccagcggcgugcccgacagauucagcggcagcaagagcggcaccagcgccagccuggccaucaccggccugcaggccgaggacgaggccgacuacuacugccagagcuacgacagcagccugagcggcuuccacguguucggcagcggcaccaaggugaccgugcug

SEQ ID NO: 35426 - RNA, 336 nt, Artificial Sequence
  derived and/or modified sequence opt4 from anti-influenza_Chain
cagagcgugcugacccagccccccagcgugagcgccgcccccggccagaaggugaccaucagcugcagcggcagcagcagcaacaucggcaacgacuacgugagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccaacuacuacugcgccaccugggacagaagacccaccgccuacgugguguucggcggcggcaccaagcugaccgugcugggc

SEQ ID NO: 35427 - RNA, 336 nt, Artificial Sequence
  derived and/or modified sequence opt4 from anti-influenza_Chain
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcaccagagccaccggcauccccgacagauucagcggcagaggcagcggcaccgacuucacccugaccaucagcagccuggagcccgaggacuucgccguguacuacugccagaacuacggcagccccuuccuguucaccuucggccccggcaccaagguggacaucaagagaaccgug

SEQ ID NO: 35428 - RNA, 336 nt, Artificial Sequence
  derived and/or modified sequence opt4 from anti-influenza_Chain
gacauccagcugacccagagcccccugagcccccccgugacccugggccagcccgccagcaucagcugcagaagcagccagagccugcuguacaccgacggcuucaccuaccugagcugguaccaccagagacccggccagagccccagaagacugaucuacaagaucagcaacagagacagcggcgugcccgacagauucagcggcagcggcagcggcaccgacuucacccugaagaucagcagaguggaggccgaggacgugggcguguacuacugcaugcaggccacccacuggccccugaccuucggcgagggcaccaagguggagaucaag

SEQ ID NO: 35429 - RNA, 336 nt, Artificial Sequence
  derived and/or modified sequence opt4 from anti-influenza_Chain
gacaucgagcugacccaggagcccagcgccagcggcacccccggccagagagugaccaucagcugcagcggcgacaccagcaacaucggcagcaacaccgugagcugguuccagcugcugcccggcaccgcccccaagcugcugaucuucaccgacaaccagagacccagcggcgugcccggcagauucagcggcagcaagagcggcaccagcgccagccuggccaucagcggccugcagagcgaggacgagaccgacuacuacugcgccgccugggacgacagccugaacggcuggguguucggcggcggcaccaagcugaccgugcugggccag

SEQ ID NO: 35430 - RNA, 336 nt, Artificial Sequence
  derived and/or modified sequence opt4 from anti-influenza_Chain
gacaucgugcugacccagagccccagcgccagcggcagccccggccagagcgugaccaucagcugcaccggcaccagcagcgacgugggcggcuacgacuacgugagcugguaccagcagcaccccggcaaggcccccaagcugaugaucuacgaggugagaaagagacccagcggcgugcccgacagauucagcggcagcaagagcggcaacaccgccagccugaccgugagcggccugcaggccgaggacgaggccuacuacuacugcgccagcuacgccggcaccuacauccaccuguucggcggcggcaccaagcugaccgugcugggccag

SEQ ID NO: 35431 - RNA, 336 nt, Artificial Sequence
  derived and/or modified sequence opt4 from anti-influenza_Chain
caggagcagcugauggagagcggcggcggccuggugaagcccggcggcagccugacccugaccugcaccgugagcggccugagccuguacagcaacgagaucaacugggugagacaggcccccggcaacggccuggaguggaucggcgccaucgccggcagcggcagcgccgacuacgccagcugggccaagagcagaagcaccaucaccagaaacaccaaccugaacaccgugacccugaagaugaccagccugaccgccgccgacaccgccaccuacuucugcgccagcuucugggaccuguggggccccggcacccuggugaccgugagcagc

SEQ ID NO: 35432 - RNA, 336 nt, Artificial Sequence
  derived and/or modified sequence opt4 from anti-influenza_Chain
cagcagcagcugauggagagcggcggcggccuggugaagcccggcggcagccugacccugaccugcaccgugagcggccugagccuguacagcaacgagaucaacugggugagacaggcccccggcaacggccuggaguggaucggcgccaucgccggcagcggcagcgccgacuacgccagcugggccaagagcagaagcaccaucaccagaaacaccgaccugaacaccgugacccugaagaugaccagccugaccgccgccgacaccgccaccuacuucugcgccagcuucugggaccuguggggccccggcacccuggugaccgugagcagc

SEQ ID NO: 35433 - RNA, 336 nt, Artificial Sequence
  derived and/or modified sequence opt4 from anti-influenza_Chain
cagcagcagcugguggagagcggcggcggccuggugaagcccggcggcagccugacccugaccugcagagugagcggccugagccuguucagcaacgagaucaacugggugagacaggcccccggcaacggccuggaguggaucggcgccaucggcggcggcggcagcgccgacuacgccagcugggccaagagcagaagcaccaucaccagaaacaccaaccugaacaccgugacccugagaaugaccagccugaccgccgccgacaccgccgccuacuucugcgccagcuucugggaccuguggggccccggcacccuggugaccgugagcagc

SEQ ID NO: 35434 - RNA, 336 nt, Artificial Sequence
  derived and/or modified sequence opt4 from anti-influenza_Chain
gaggugcagcugguggagagcggcggcggccuggugaagcccggcggcagccugagacugagcugcgccgccagcggccugagccuguucagcaacgagaucaacugggugagacaggcccccggcaagggccuggaguggaucggcgccaucggcggcggcggcagcgccgacuacgccagcugggccaagagcagauucaccaucagcagagacaacgccaagaacagccuguaccugcagaugaacagccugagagccgaggacaccgccguguacuucugcgccagcuucugggaccuguggggccccggcacccuggugaccgugagcagc

SEQ ID NO: 35435 - RNA, 336 nt, Artificial Sequence
  derived and/or modified sequence opt4 from anti-influenza_Chain
gacaucgugaugacccagagcccccugagccugcccgugacccccggcgagcccgccagcaucagcugcagaagcagccagagccugcugagaagcaacggcuacaacuaccuggacugguaccugcagaagcccggccagagcccccagcugcugaucuaccugggcagcaacagagccagcggcgugcccgacagauucagcggcagcggcagcggcaccgacuucacccugaagaucagcagaguggaggccgaggacgugggcguguacuacugcaugcaggcccugcagacccccuacaccuucggccagggcaccaagcuggagaucaag

SEQ ID NO: 35436 - RNA, 339 nt, Artificial Sequence
  derived and/or modified sequence opt4 from anti-influenza_Chain
gacaucgugaugacccagagccccgacuuccugcccgugagccugggcgagagagccaccaucaacugcaagagcagccagagagugcuguacagcagcaacaacaagaacuaccuggccugguaccagcugaagcccggccagccccccaagcugaucaucuacugggccagcaccagagagagcggcgugcccgacagauucagcggcagcggcagcggcaccgaguucacccugaccaucagcagccugcaggccgaggacguggccguguacuacugccagcaguacuacagcagacccuacaccuucggccagggcaccaagcuggagaucaag

SEQ ID NO: 35437 - RNA, 339 nt, Artificial Sequence
  derived and/or modified sequence opt4 from anti-influenza_Chain
gacaucgugaugacccagagccccgacagccuggccgugagccugggcgagagagccaccaucaacugcaagagcagccagagcgugcuguacagcagcaacaacaagaacuaccuggccugguaccagcagaagcccggccagccccccaagcugcugaucuacugggccagcaccagagagagcggcgugcccgacagaaucagcggcagcggcagcggcgccgacuucacccugaccaucagcagccugcaggccgaggacguggccguguacuacugccagcaguacuucgccacccccagaaccuucggccagggcaccaagguggagaucaag

SEQ ID NO: 35438 - RNA, 339 nt, Artificial Sequence
  derived and/or modified sequence opt4 from anti-influenza_Chain
gacaucgugaugacccagagccccgacagccuggccgugagccugggcgagagagccaccaucaacugcaagagcagccagagcgugcuguacagcagcaacaacaagagccaccuggccugguaccagcagaagcccggccagccccccaagcugcugaucuacugggccagcaccagagagagcggcgugcccgacagauucagcggcagcggcagcggcaccgacuucacccugaucaucagcagccugcaggccgaggacguggccguguacuacugccagcaguacuacuucagcccccugaccuucggcggcggcaccaagguggagaucaag

SEQ ID NO: 35439 - RNA, 339 nt, Artificial Sequence
  derived and/or modified sequence opt4 from anti-influenza_Chain
gacaucgugaugacccagagccccgacagccuggccgugagccugggcgagagagccaccaucaacugcagaagcagccagagcaucuuccacaacagcaacaacgagaacuaccuggccugguaccagcagaagcccggccagccccccaagcugcugaucuacugggccagcaccagagagagcggcgugcccgacagauucagcggcagcggcagcggcaccgacuucacccugaccaucagcagccugcaggccgaggacguggccguguacuucugccagcaguacuacaacgccccccugaccuucggcggcggcaccaagguggagaucaag

SEQ ID NO: 35440 - RNA, 339 nt, Artificial Sequence
  derived and/or modified sequence opt4 from anti-influenza_Chain
gagaucgugcugacccagagcccccugagccugcccgugacccccggcgagcccgccagcaucagcugcagaagcagccagagccugcugcacagcaacggcuacaacuaccuggacugguaccugcagaagcccggccagagcccccagcugcugaucuaccugggcagcaacagagccagcggcgugcccgacagauucagcggcagcggcagcggcaccgacuucacccugaagaucagcagaguggaggccgaggacgugggcguguacuacugcaugcaggcccugcagaccccccugaccuucggcggcggcaccaagguggagaucaagaga

SEQ ID NO: 35441 - RNA, 339 nt, Artificial Sequence
  derived and/or modified sequence opt4 from anti-influenza_Chain
gacaucgugcugacccagccccccagcgugagcguggcccccggccagaccgccaccaucaccugcggcggcaacuacaucggcagcaagagcgugaacugguaccagcagagacccggccacgcccccgugcuggugguguacgacgacagcgacagacccagcggcauccccgacagauucagcggcagcaacagcagaagcaccgccaccaccgccacccugaccaucagcagaguggaggccggcgacgaggccgacuacuacugccaggugugggagaccagcgaggaccuguggguguucggcggcggcaccaagcugaccgugcugggccag

SEQ ID NO: 35442 - RNA, 342 nt, Artificial Sequence
  derived and/or modified sequence opt4 from anti-influenza_Chain
gacguggugaugacccagagccccgacagccuggccgugagccugggcgagagagccaccaucaacugcaagagcagccagagcgugcuguacagcagcaacaacaagaacuaccuggccugguaccagcagaagcccggccagccccccaagcugcugaucuacugggccagcaccagagagagcggcgugcccgacagauucagcggcagcggcagcggcaccgacuucacccugaccaucagcagccugcaggccgaggacguggccguguacuacugccagcaguacuacagcaccccccugaccuucggcggcggcaccaagguggacaucaagaga

SEQ ID NO: 35443 - RNA, 342 nt, Artificial Sequence
  derived and/or modified sequence opt4 from anti-influenza_Chain
gacauccagaugacccagagccccgacagccuggccgugagccugggcgagaaggccaccaucaacugcaagagcagccagagcauccugaacagcagcaacaacaagaacuaccuggccugguaccagcagaagcccggccagccccccaagcugcugaucuacugggccagcaccagagagagcggcgugcccgacagauucagcggcagcggcagcggcaccgacuucacccugaccaucagcagccugcaggccgaggacguggccguguacuacugccagcaguacuacagcagcccccccaccuucggccagggcaccaagguggagaucaagaga

SEQ ID NO: 35444 - RNA, 342 nt, Artificial Sequence
  derived and/or modified sequence opt4 from anti-influenza_Chain
gagaucgugcugacccagagccccgccacccugagccuguaccccggcgagagagccacccugagcugcagagccagccagagcgugagcagauaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugcugcgacagacagcagagaagcaacuggcugaagaucaccuucggccagggcaccagacuggagaucaagggcaccgug

SEQ ID NO: 35445 - RNA, 342 nt, Artificial Sequence
  derived and/or modified sequence opt4 from anti-influenza_Chain
gacaucgugaugacccagagccagaaguucgugagcaccagcgugggcgacagagugagcgugaccugcaaggccagccagaacgugggcagcaacguggccugguaccagcacaagcccggccacagccccaccgcccugaucuacagcgccagccacagauacagcggcgugcccgacagauucaccggcagcgagagcggcaccgacuucacccugaccaucagcaacgugcagagcgaggaccuggccgaguacuucugccagcaguacuacagcuaccccuacaccuucggcggcggcaccaagcuggagaucaagagagccgacgccgcccccacc

SEQ ID NO: 35446 - RNA, 342 nt, Artificial Sequence
  derived and/or modified sequence opt4 from anti-influenza_Chain
gacaucgagaugacccagagcccccugagccugcccgugacccccggcgagagcgccagcaucagcugcagaagcagccagagccugcugcacagcaacggcuacaacuaccuggacugguaccugcagaagcccggccagagcccccagcugcugaucuaccugggcagcagcagagccagcggcgugcccgacagauucagcggcagcggcagcggcaccgacuucacccugaagaucagcagaguggaggccgaggacgugggcguguacuacugcaugcagggccugcagacccccuacaccuucggccagggcaccaagcuggagaucaagagaacc

SEQ ID NO: 35447 - RNA, 342 nt, Artificial Sequence
  derived and/or modified sequence opt4 from anti-influenza_Chain
gacaucgagaugacccagagcccccugagccugcccgugacccccggcgagcccgccagcaucagcugcagaagcagccagagccugcugcacagcaacggcuacaaccaccuggccugguaccugcagaagcccggcagaagcccccaccugcugaucuaccuggccagcaccagagccagcggcgugcccgacagauucagcggcagcggcagcggcaccgacuucacccugaagaucagcagaguggaggccgaggacgugggcaucuacuacugcaugcagagccugcagaccagcaucaccuucggccagggcaccagacuggagaucaagagaacc

SEQ ID NO: 35448 - RNA, 345 nt, Artificial Sequence
  derived and/or modified sequence opt4 from anti-influenza_Chain
caggugcagcuggugcagagcggcgccgaggugaagaagcccggcagcagcgugagagugagcugcaagaccagcggcggcaccuucagcagcuacgccgugaccugggugagacaggcccccggccagggccuggaguggaugggcggcaucaucggcauguucggcaccaccaacuacgcccagaaguuccagggcagacugaccaucaccgccgacgagaugaccagcaccgccuacauggagcugagcagccugagaagcgaggacaccgccguguacuacugcgccagaggcagcuacuacuacgagaccacccuggacuacuggggcagaggcacccug

SEQ ID NO: 35449 - RNA, 345 nt, Artificial Sequence
  derived and/or modified sequence opt4 from anti-influenza_Chain
gaggugcagcuggugcagagcggcgccgaggugaagaagcccggcagcagcgugaaggugagcugcaagaccagcggcggcaccuucagcagcuacgccgugaccugggugagacaggcccccggccagggccuggaguggaugggcgccaucaucggcauguucggcaccaccaacuacgcccagaaguuccagggcagagugaccaucaccgccgacgagcugaccagcaccgccuacauggagcugagcagccugagaagcgacgacaccgccguguacuacugcgccagaggcagcuacuacuacgagagcagccuggacuacuggggcaagggcacccug

SEQ ID NO: 35450 - RNA, 345 nt, Artificial Sequence
  derived and/or modified sequence opt4 from anti-influenza_Chain
caggugcagcuggugcagagcggcgccgaggugaagaagcccggcagcagcgugaaggugagcugcaagaccagcggcggcaccuucagcagcuacgccgugaccugggugagacaggcccccggccagggccuggaguggaugggcggcaucaucggcauguucggcaccaccaacuacgcccagaaguuccagggcagagugaccaucaccgccgacgagcugaccagcaccgccuacauggagcugagcagccugagaagcgaggacaccgccguguacuacugcgccagaggcagcuacuacuacgagagcagccuggacuacuggggcagaggcacccug

SEQ ID NO: 35451 - RNA, 345 nt, Artificial Sequence
  derived and/or modified sequence opt4 from anti-influenza_Chain
gaggugcagcuggugcagagcggcgccgaggugaagaagcccggcgccagcgugaaggugagcugcaaggccagcggcuacaccuucaccggcuacuacguguacugggugagacaggcccccggccagggccuggaguggaugggcuggaucagcgccuacaacggcaacaccaacuacgcccagaaguuccagggcagagugaccaucaccgccgacaagagcaccagcaccgccuacauggagcugagcagccugagaagcgaggacaccgccguguacuacugcgccagaagcagaagccuggacguguggggccagggcaccaccgugaccgugagcagc

SEQ ID NO: 35452 - RNA, 345 nt, Artificial Sequence
  derived and/or modified sequence opt4 from anti-influenza_Chain
gacaucgugaugacccagagcccccugagccugcccgugacccccggcgagcccgccagcaucagcugcagaagcagccagagccugcugcacagcaacggccacaucuacuucgacugguaccugcagaagcccggccagagcccccagcugcugaucuaccuggugagcaagagagccagcggcgugcccgacagauucagcggcagcggcagcggcaccgacuucacccugaagaucagcagaguggaggccgaggacgugggcguguacuacugcaugcaggcccuggagacccccuucaccuucggccccggcaccaaggugcacaucaagagaaccgug

SEQ ID NO: 35453 - RNA, 345 nt, Artificial Sequence
  derived and/or modified sequence opt4 from anti-influenza_Chain
cagagcgcccugacccagcccgccagcgugagcggcagccccggccagagcaucaccaucagcugcaccggcaccagcagcgacgugggcgccuacaacuacgugagcugguaccagcaccaccccggcaaggcccccaagcugaugaucuacgacgugaccuacagacccagcggcgugagcaccagauucagcggcagcaagagcggcaacaccgccagccugaccaucagcggccugcaggccgaggacgaggccgacuacuacugcagcagccagagcagaagcagcacccuggugaucuucggcggcggcaccaagcugaccgugcugggccagcccaag

SEQ ID NO: 35454 - RNA, 345 nt, Artificial Sequence
  derived and/or modified sequence opt4 from anti-influenza_Chain
gacaucgugcugacccagagccccgugagccuggccgugagccugggcgagagcgccaccgugaacugcaagagcagccagagcgugcugagcaacagcaagaaccugaacuaccuggccugguaccagcacaagcccggccagccccccaagcugcugaucuacugggccagcaccagagagagcggcgugcccgacagauucagcggcagcggcagcggcaccgacuucacccugaccaucagcagccugcaggccgaggacguggccguguacuacugccagcagcacuacagcaucccccugaccuucggccccggcaccaagguggacaucaagagaacc

SEQ ID NO: 35455 - RNA, 348 nt, Artificial Sequence
  derived and/or modified sequence opt4 from anti-influenza_Chain
gacaucgugcugacccagagcccccugagccugcccgugacccccggcgagcccgccagcaucagcugcagaagcagccagagccugcuggacagcaacggcuacaacuaccuggacugguaccugcagaagcccggccagagcccccagcugcugaucuaccuggccagcuacagagcccccggcgugcccgacagauucagcggcagcggcagcggcaccgacuucacccugaagaucagcagaguggaggccgaggacgugggccuguacuacugcaugcaggcccugcagaccccccccauguacaccuucggccagggcaccaagcuggagaucaagagaacc

SEQ ID NO: 35456 - RNA, 351 nt, Artificial Sequence
  derived and/or modified sequence opt4 from anti-influenza_Chain
cuggagagcggcggcggccuggugcagcccggcggcagccugagacugagcugcgccgccagcggcaucaccuucagcagcuacgccaugagcugggugagacaggcccccggcaagggccuggagugggugagcaccgugaacagcggcggcggcagcaccuacuacggcgacagcgugagaggcagauucaccaucagcagagacaacagcaagagcacccuguaccugcagcugaacagccugagagccgaggacaccgccaucuacuacugcgccaaggacaagggcagacccaucuucggccuggugacccccagcuacuacauggacguguggggcaacggcacc

SEQ ID NO: 35457 - RNA, 351 nt, Artificial Sequence
  derived and/or modified sequence opt4 from anti-influenza_Chain
caggagcagcuggugcagagcggcgccgaggugaagaagcccggcgccagcgugaaggugagcugcaaggccagcagaaagagcuucaucggcuacuacgugcacugggugagacaggcccccggccagggccuggaguggaugggcuggaucagccccgacagcgacgccaccaaguacgcccagaaguuccagggcagcgugaucaugaccagagacaccagcgugagcaccguguacauggagcugagcagacugaccagcgacgacaccgcccuguacuacugccugcuguucagaggcggcaacagccugagcuggggccagggcacccuggugaccgugagcagc

SEQ ID NO: 35458 - RNA, 351 nt, Artificial Sequence
  derived and/or modified sequence opt4 from anti-influenza_Chain
caggugcagcugcaggagagcggccccggccuggugaagcccagcgagacccugagccugaccugcaccgugagcggcagcagcaucagcaacuacuacuggagcuggaucagacagagccccggcaagggccuggaguggaucggcuucaucuacuacggcggcaacaccaaguacaaccccagccugaagagcagagugaccaucagccaggacaccagcaagagccaggugagccugaccaugagcagcgugaccgccgccgagagcgccguguacuucugcgccagagccagcugcagcggcggcuacugcauccuggacuacuggggccagggcacccuggugacc

SEQ ID NO: 35459 - RNA, 351 nt, Artificial Sequence
  derived and/or modified sequence opt4 from anti-influenza_Chain
gaggugcagcugguggagagcggcggcggccuggugcagcccggcggcagccugagacugagcugcgccgccagcggcuucaccuucagcaucuacgccaugagcugggugagacaggcccccggcaagggccuggagugggugagcgccaucagcagcagcggcgacagcaccuacuacgccgacagcgugaagggcagauucaccaucagcagagacaacgccagaaacacccuguaccugcagaugaacagccugagagccgaggacaccgccguguacuacugcgccagagccuacggcuacaccuucgaccccuggggccagggcacccuggugaccgugagcagc

SEQ ID NO: 35460 - RNA, 354 nt, Artificial Sequence
  derived and/or modified sequence opt4 from anti-influenza_Chain
caggugcagcugcaggagagcggccccggccuggugaagcccagcgagacccugagccugaccugcaccgugagcggcuacagcuucgacagcggcuacuacuggggcuggcugagacagccccccggcaagggccuggaguggaucggcagcaucuaccacagcagaaacaccuacuacaaccccagccugaagagcagagugaccaucagcguggacaccagcaagaaccaguucagccugcagcugagcagcgugaccgccgccgacaccgccguguacuacugcgccagaggcaccugguacagcagcaaccugagauacugguucgaccccuggggcaagggcacccug

SEQ ID NO: 35461 - RNA, 354 nt, Artificial Sequence
  derived and/or modified sequence opt4 from anti-influenza_Chain
cagcccgugcugacccagccccccagcgccagcgccagccugggcgccagcgugacccugaccugcacccugagcagcgccuacagcaacuacaagguggacugguaccagcagagacccggcaagggccccagauucgugaugagagugggcaccggcggcaucgugggcagcaagggcgacggcauccccgacagauucagcgugcugggcagcggccugaacagauaccugaccaucaagaacauccaggaggaggacgagagcgacuaccacugcggcgccgaccacggcagcggcagcaacuucgugagccccuacguguucggcggcggcaccaagcugaccgugcug

SEQ ID NO: 35462 - RNA, 354 nt, Artificial Sequence
  derived and/or modified sequence opt4 from anti-influenza_Chain
caggugcagcuggugcagagcggcgccgacgugaagaagcccggcagcagcgugaccgugagcugcaaggccagcggcggcagcuucagcaacuacggcaucaacugggugagacaggcccccggccagggccuggaguggaugggcggcaucaucccccugaucaacgcccccaacuacgcccccaaguuccagggcagagugaccaucaccgccgacauguucagcaacaucgugagccugcagcugaccagccugagaaccgacgacaccgccguguacuacugcgccagaagaaagaugaccaccgccaucgacuacuggggccagggcacccuggugaccgugagcagc

SEQ ID NO: 35463 - RNA, 354 nt, Artificial Sequence
  derived and/or modified sequence opt4 from anti-influenza_Chain
caggugcagcuggugcagagcggcgccgaggugaagaagcccggcagcagcgugaaggugagcugcagagagagcggcggcaccuucaacggcuacaccaucaccugggugagacaggcccccggccagggccuggaguggaugggcggcaucauccccaugaugggcaccgugaacuacgcccagaagcugcagggcagagugaccaucaccaccgacuacuucaccaagaccgccuacauggaccugaacaaccugagaagcgaggacaccgccauguacuacugcgugaagaucagauacaccggccagcagcugcuguggggccagggcacccuggugaccgugagcagc

SEQ ID NO: 35464 - RNA, 354 nt, Artificial Sequence
  derived and/or modified sequence opt4 from anti-influenza_Chain
caggugcagcuggugcagagcggcgccgaggugaagaagcccggcgccagcgugaaggugagcugcaaggccagcggccacaccuucaccggcuacuacauccacugggugagacaggcccccggccagggccuggaguggaugggcuggaucaaccccgacagcggcgccaccagcagcgcccagaacuuccagggcagagugaccaugaccggcgacaccagcagcagcaccgccuacauggagcugagcagacugagcuucgacgacaccgccguguacuacugcgccagagugcuguucaccagccccuucgacuucuggggcgagggcacccuggugaccgugagcagc

SEQ ID NO: 35465 - RNA, 354 nt, Artificial Sequence
  derived and/or modified sequence opt4 from anti-influenza_Chain
cagcccgugcugagccagccccccagcgccagcgccagccugggcgccagcgugacccugaccugcacccugagcagcggcuucgacaacuaccagguggccugguaccagcagagacccggcaagggccccagauucgugaugagagugggcaacggcggcaacguggccagcaagggcgacggcauccccgacagauucagcgugagcggcagcggccugaacagauaccugaccaucaagaacauccaggaggacgacgagagcgacuacuacugcggcgccgaccacggcagcggcaacaacuucgugagccccuacguguucggcggcggcaccaagcugaccgugcug

SEQ ID NO: 35466 - RNA, 354 nt, Artificial Sequence
  derived and/or modified sequence opt4 from anti-influenza_Chain
gaggugcagcugguggagagcggcgccgaggugaagaagcccggcgccagcgugaaggugagcugcaaggccagcggcuacaccuucagcagauacuacauccacugggugagacaggcccccggccaggagcuggaguggaugggcuggaucaaccccgacagcggcgacaccaacuacgcccagaaguucagaggcagagugaccauggccagagacaccagcaucagcaccguguacauggagcugaacagccugagauacgacgacaccgccguguacuucugcgccagaaucaucuggagcagcagcggcauggacguguggggccagggcaccaccgugaccgugagc

SEQ ID NO: 35467 - RNA, 354 nt, Artificial Sequence
  derived and/or modified sequence opt4 from anti-influenza_Chain
gaggugcagcugcuggagagcggcggcggcguggugcagcccggcagaagccugagacugagcugcgccgccagcggcuucaccuucagaaccuacggcaugcacugggugagacaggcccccggcaagggccuggaguggguggccgugaucagccacgacggcaaccugaaguacuacggcggcagcgugaagggcagauucaccaucagcagagacaacagcaagaacgcccuguaccugcagaugaacagccugagaguggacgacaccgcccuguacuacugcgccagaggcaucggcaucaccgacgccuucgacaucagaggccagggcaccauggugguggugagc

SEQ ID NO: 35468 - RNA, 354 nt, Artificial Sequence
  derived and/or modified sequence opt4 from anti-influenza_Chain
gaggugcagcugguggagagcggcggcggccuggugcagcccggcggcagccugagacugagcugcaccgccagcggccugagcgugagcagcaccuacaugaacugggugagacaggcccccggcaagggccuggagugggugagcguguucuacagcgagaccagaaccuacuacgccgacagcgugaagggcagauucaccgugagcagacacaacagcaacaacacccuguaccugcagaugaacagccugagaguggaggacaccgccguguacuacugcgccagagugcagagacugagcuacggcauggacguguggggccagggcaccaccgugaccgugagcagc

SEQ ID NO: 35469 - RNA, 354 nt, Artificial Sequence
  derived and/or modified sequence opt4 from anti-influenza_Chain
gaggugcagcugguggagagcggcggcggccuggugcagcccggcggcagccugagacugagcugcaccgccagcggccugagcgugagcagcaccuacaugaacugggugagacaggcccccggcaagggccuggagugggugagcguguucuacagcgagaccagaaccuacuacgccgacagcgugaagggcagauucaccgugagcagacacaacagcaacaacacccuguaccugcagaugaacagccugagagccgaggacaccgccguguacuacugcgccagagugcagagacugagcuacggcauggacguguggggccagggcaccaccgugaccgugagcagc

SEQ ID NO: 35470 - RNA, 354 nt, Artificial Sequence
  derived and/or modified sequence opt4 from anti-influenza_Chain
gacaugcagcugguggagagcggcggcggccuggugccccccggcggcagccugagacugagcugcgccgccagcggcuucagcgugagcgacaacuacaucaacugggugagacaggcccccggcaagggccuggacugggugagcguguucuacagcgccgacagaaccagcuacgccgacagcgugaagggcagauucaccgugagcagccacgacagcaagaacaccguguaccugcagaugaacagccugagagccgaggacaccgccguguacuacugcgccagagugcagaagagcuacuacggcauggacguguggggccagggcaccaccgugaccgugagcagc

SEQ ID NO: 35471 - RNA, 357 nt, Artificial Sequence
  derived and/or modified sequence opt4 from anti-influenza_Chain
gaggugcagcugguggagagcggccccgugcuggugaagcccaccgagacccugaccgugaccugcaccgugagcggcuucagcguggacaacgacagaaugggcgugagcuggaucagacagccccccggcaaggcccuggaguggcuggcccacaucuucagcaacgacgagaagagcuacagcaccagccugagaagcagacugaccaucagcaaggacaccagcaagagacagguggugcugagcaugaccgacauggaccccguggacaccgccaccuacuacugcgccagagcccccagcgaguacgccgccauggacguguggggccagggcaccauggugaccgugagc

SEQ ID NO: 35472 - RNA, 357 nt, Artificial Sequence
  derived and/or modified sequence opt4 from anti-influenza_Chain
caggugcagguggugcagagcggcaccgaggugaagaagcccggcagcagcgugaaggugagcugccagaccagcggcggcagauucaugagcuacgccaucaccugggugagacaggcccccggccagggccuggaguggaugggcggcaucgugcccguguucggcaccgccaacuacgcccagaaguuccagggcagagugaccaucaccaccgacgacagcaccagaaccgccuacauggagcugagcagccugagaagcgaggacaccgccguguacuacugcggcuucagauacggcagcggcuacggcuucgacagcuggggccagggcacccuggugaccgugagcagc

SEQ ID NO: 35473 - RNA, 357 nt, Artificial Sequence
  derived and/or modified sequence opt4 from anti-influenza_Chain
gaggugcagcugguggagagcggcgccggcgugaagaagcccggcagcagcgugaaggugagcugcaaggccagcggcaacaccuucagcagcaacgccaucagcugggugagacaggcccccggccagggccuggaguggaugggcggcauccugggcaugcugagaaccaccaacuacgcccagaaguuccagggcagagugaccaucaccgccgacgaguucaugaacaccgccuacauggagcugagcagccugaccagcgaggacaccgccguguacuacugcgccagaagcagcggcuacuaccccgacuacuuccaccuguggggccagggcacccuggugaccgugagc

SEQ ID NO: 35474 - RNA, 357 nt, Artificial Sequence
  derived and/or modified sequence opt4 from anti-influenza_Chain
caggugcagcugcaggagagcggccccggccuggugaagcccagcgagacccugagccugaccugcaccgugagcggcagcagcaucagcaacuacuacuggagcuggaucagacagagccccggcaagggccuggaguggaucggcuucaucuacuacggcggcaacaccaaguacaaccccagccugaagagcagagugaccaucagccaggacaccagcaagagccaggugagccugaccaugagcagcgugaccgccgccgagagcgccguguacuucugcgccagagccagcugcagcggcggcuacugcauccuggacuacuggggccagggcacccuggugaccgugagc

SEQ ID NO: 35475 - RNA, 357 nt, Artificial Sequence
  derived and/or modified sequence opt4 from anti-influenza_Chain
gaggugcagcugguggagagcggcggcggccuggugcagcccggcggcagccugagaaucagcugcgccgccagcggcuucaccgugagcagcaacuacaugagcugggugagacaggcccccggcaagggccuggagugggugagcgugaucuacagcggcggcagcaccuacuacgccgacagcgugaagggcagauucagcuucagcagagacaacagcaagaacaccguguuccugcagaugaacagccugagagccgaggacaccgccguguacuacugcgccagaugccugagcagaaugagaggcuacggccuggacguguggggccagggcaccaccgugaccgugagc

SEQ ID NO: 35476 - RNA, 357 nt, Artificial Sequence
  derived and/or modified sequence opt4 from anti-influenza_Chain
caggugcagcugcaggagagcggccccggccuggugaagcccagcgagacccugagccugaccugcaccgugagcggcgccagcaucagcagcgacuacuggagcuggaucagacugccccccggcaagggccuggaguggaucggcuacaucuacaacagaggcagcaccaaguacacccccagccugaagagcagagugaccaucagccuggacaccgccgagaaccaguucagccugagacugagaagcgugaccgccgccgacaccgccaucuacuacugcgccagacacgugggcggccacaccuacggcaucgacuacuggggccagggcacccuggugaccgugagcagc

SEQ ID NO: 35477 - RNA, 357 nt, Artificial Sequence
  derived and/or modified sequence opt4 from anti-influenza_Chain
caggugcagcugcaggagagcggccccggccuggugaagcccagcgagacccugagccugaccugcaccgugagcggcgccagcaucagcagcgacuacuggagcuggaucagacugccccccggcaagggccuggaguggaucggcuacaucuacaacagaggcagcaccaaguacacccccagccugaagagcagagugaccaucagccuggacaccgccgagaaccaguucagccugagacugagaagcgugaccgccgccgacaccgccguguacuacugcgccagacacgugggcggccacaccuacggcaucgacuacuggggccagggcacccuggugaccgugagcagc

SEQ ID NO: 35478 - RNA, 357 nt, Artificial Sequence
  derived and/or modified sequence opt4 from anti-influenza_Chain
caggugcagcugcaggagagcggccccagacuggugaagcccagcgagagccugagccugaccugcaccgugagcggcggcagcaucagcaacagcuucuggggcuggaucagacagccccccggcgagggccuggaguggaucggcuacguguacaacagcggcaacaccaaguacaaccccagccugaagagcagagugaccaucagcagagacaccagcaagagccagcuguacaugaagcugagaagcgugaccgccgccgacaccgccguguacuacugcgccagacacgacgacgccagccacggcuacagcaucagcuggggccacggcacccuggugaccgugagcagc

SEQ ID NO: 35479 - RNA, 357 nt, Artificial Sequence
  derived and/or modified sequence opt4 from anti-influenza_Chain
gaggugcaccugcagcagagcggccccgagcuggugaagcccggcgccagcgugaagaugagcugcgaggccagcggcuacaccuucaccgacuacuacguggccugggugaagcagagccccggcgagagcuucgaguggaucggcagagugaaccccuacagcggcggcaccagcuacaaccagaaguucaagggcaaggccacccugaucguggacaagagcagcagcaccgccuacauggagcugagcagccugaccagcgaggacagcgccguguacuacugcgccagaugggacuacggcguguacgagggcuacaucgacuacuggggccagggcagcgcccugaccgug

SEQ ID NO: 35480 - RNA, 360 nt, Artificial Sequence
  derived and/or modified sequence opt4 from anti-influenza_Chain
caggugcagcuggugcagcccggcgccgaggugaagaagcccggcagcagcgugaaggugagcugcaaggccagcggcggcaucuucagccccuacgccaucagcugggugagacaggcccccggccagggccuggaguggaugggcggcaucaucgccaucuucggcaccaccaacuacgcccagaaguuccagggcagagugaccaucaccgccgacaagagcaccaccaccgccuaccuggagcugaacagccugagauucgaggacaccgccguguacuacugcgccagaggcggcagauacuacguggacuacuucgacuacuggggccagggcacccuggugagcgugagcagc

SEQ ID NO: 35481 - RNA, 360 nt, Artificial Sequence
  derived and/or modified sequence opt4 from anti-influenza_Chain
caggugcagcugcaggagagcggccccgaccuggugaagcccggcgccagcgugaagaugagcugcaaggccagcggcuacagcuucaccuacuaccacaugcacugggugaagcagacccacggcaagagccuggaguggaucggcagaauccccuacaacggcggcaccaacuacagccagagauucaagggcaaggccguguucaccguggacaugagcagcagcaccgccuacauggagcugagaagccugaccagcgaggacagcgccguguacuacugcgccagagacgccaacuacgagggcgacugguacuucgacguguggggccagggcaccaccgugaccgugagcagc

SEQ ID NO: 35482 - RNA, 360 nt, Artificial Sequence
  derived and/or modified sequence opt4 from anti-influenza_Chain
caggugcagcuggugcagagcggcgccgaggugaaggagcccggcagcgccaugaaggugagcugcaaggccagcggcggcaccuucagcagcgacgccuucugcugggugagacaggcccccggcagaggccuggaguggaugggcggcaucauccccguguuccagaccgccaacuacggccccaacuuccagggcagagugaccaucagcgccgacguguacaccaccacccuguaccuggagcugagcggccugaccagcgaggacaccgccguguacuucugcgccagaagcggcgacggcuacaacuacuacuucccccuguggggccagggcacccuggugaccgugagcagc

SEQ ID NO: 35483 - RNA, 360 nt, Artificial Sequence
  derived and/or modified sequence opt4 from anti-influenza_Chain
cagaucacccugagagagagcggccccacccuggugaagcccacccagacccugacccugaccugcaccuucagcggcuucagccugagcaccaacggcgugaacgugggcuggaucagacagccccccggcaaggcccuggaguggcuggcccugaucuacugggacgacgacaagagauacagccccagccugaagagaagacugaccaucaccaaggacaccagcaagaaccagguggugcugacccugaccaacauggaccccguggacaccgccaccuacuacugcgcccacagacccgacuucuacggcgacuucgaguacuggggccccggcacccuggugaccgugagcagc

SEQ ID NO: 35484 - RNA, 360 nt, Artificial Sequence
  derived and/or modified sequence opt4 from anti-influenza_Chain
caggugcagcuggugcagagcggcagcgaggugaagaagcccggcaccagcgugaaggugagcugcaccgccagcggcagcguguucaccaacuacggcaucagcugggugagacaggcccccggccagggccuggaguggaugggcggcaucaucccccuguucggcgccgccaaguacgcccagaaguuccagggcagagugaccaucaccgccgacgagagcaccaagaccguguacauggagcugagcagacugaccagcaaggacaccgccaucuacuucugcgccaaggcccccagaguguacgaguacuacuucgaccaguggggccagggcacccccgugaccgugagcagc

SEQ ID NO: 35485 - RNA, 360 nt, Artificial Sequence
  derived and/or modified sequence opt4 from anti-influenza_Chain
caggugcagcuggugcagagcggcgccgaccugaagaagcccggcgccagcgugaaggugagcugcaaggccagcggcuacaccuucaccgacuacuacauccacugggugagacaggcccccggccagggccuggaguggaugggcuggaucaaccccgagagcggcgacaccaaguacgcccagaaguuccagggcagagugaccaugaccagagacaccagcaucaccaccgccuacauggagcugggcagacugagaagcgacgacaccgccguguacuacugcgccagagacgugagcaccaccuggagcugguucgcccccuggggccagggcacccuggugaccgugagcagc

SEQ ID NO: 35486 - RNA, 360 nt, Artificial Sequence
  derived and/or modified sequence opt4 from anti-influenza_Chain
caggugcagcugcaggagagcggccccggccuggugaagcccagcgagacccugagccugaccugcagcgugagcggcggcagcaucaacuacuacuacuggagcuggaucagacagccccccggcaagggccuggagugcaucggcuacaucagcgacaccggcagaaccuacuacaaccccagccugagaagcagagugaccaucagcguggacaccagcaagaaccaguucagccugaaccugaccagcaugaccgccgccgacaccgccguguacuacugcgccagagaccccaccggcagcagacagaagaacgccuucgacauguggggccagggcaccauggugaccgugagc

SEQ ID NO: 35487 - RNA, 360 nt, Artificial Sequence
  derived and/or modified sequence opt4 from anti-influenza_Chain
caggugcagcugcaggagagcggccccagaguggugagacccagcgagacccugagccugaccugcaccgugagcggcggcagcaucagcagcuacaacuggaucuggaucagacagccccccggcaagggccuggaguggaucggccacaucuacgacuacggcagaaccuucuacaacagcagccugcagagcagacccaccaucagcguggacgccagcaagaaccagcugagccugagacugaccagcgugaccgccagcgacaccgccguguacuacugcgccagaccccugggcauccugcacuacuacgccauggaccuguggggccagggcaccaccgugaccgugagcagc

SEQ ID NO: 35488 - RNA, 360 nt, Artificial Sequence
  derived and/or modified sequence opt4 from anti-influenza_Chain
caggugcagcugcaggagagcggccccggccuggugaagcccagcgagacccugagccugaccugcagcgugagcggcggcagcaucagcagcgacuucuggagcuggaucagacagccccccggcaagggccuggaguggaucggcuacguguacaacagaggcagcaccaaguacagccccagccugaagagcagagugaccaucagcgccgacaugagcaagaaccaguucagccugaacaugagcagcgugaccgccgccgacaccgccguguacuacugcgccaagaacggcagaagcagcaccagcuggggcaucgacguguggggcaagggcaccaccgugaccgugagcagc

SEQ ID NO: 35489 - RNA, 360 nt, Artificial Sequence
  derived and/or modified sequence opt4 from anti-influenza_Chain
caggugcagcugcaggagagcggccccggccuggugaagcccagcgagacccugagccugaccugcaccgugagcggcggcagcaucagcgccuaccacuggagcuggaucagacagccccccggcaagggccuggaguggaucggccacaucuucgacagcggcagcaccuacuacaaccccagccugaagagcagagugaccaucagccuggacgccagcaagaaccagcugagccugagacugaccagcgugaccgccagcgacaccgccaucuacuacugcgccagaccccugggcagcagauacuacuacggcauggacguguggggccagggcaccaccgugaccgugagcagc

SEQ ID NO: 35490 - RNA, 360 nt, Artificial Sequence
  derived and/or modified sequence opt4 from anti-influenza_Chain
gaggugcagcugguggagagcggcggcggccuggugcagcccggcggcagccugagaaucagcugcgccgccagcggcuucaccgugagcagcaacuacaugagcugggugagacaggcccccggcaagggccuggagugggugagcgugaucuacagcggcggcagcaccuacuacgccgacagcgugaagggcagauucagcuucagcagagacaacagcaagaacaccguguuccugcagaugaacagccugagagccgaggacaccgccguguacuacugcgccagaugccugagcagaaugagaggcuacggccuggacguguggggccagggcaccaccgugaccgugagcagc

SEQ ID NO: 35491 - RNA, 360 nt, Artificial Sequence
  derived and/or modified sequence opt4 from anti-influenza_Chain
caggugcagcugcaggagagcggccccggccuggugaagcccagcgagacccugagccugaccugcaccgugagcggcagcagcaucagcaacuacuacuggagcuggaucagacagagccccggcaagggccuggaguggaucggcuucaucuacuacggcggcaacaccaaguacaaccccagccugaagagcagagugaccaucagccaggacaccagcaagagccaggugagccugaccaugagcagcgugaccgccgccgagagcgccguguacuucugcgccagagccagcugcagcggcggcuacugcauccuggacuacuggggccagggcacccuggugaccgugagcagc

SEQ ID NO: 35492 - RNA, 360 nt, Artificial Sequence
  derived and/or modified sequence opt4 from anti-influenza_Chain
caggugcagcugcagcagagcggcgccgaggugaagaagcccggcagcagcgugaaggugagcugcaaggugagcggcgugaucuucagcggcagcgccaucagcugggugagacaggcccccggccagggccuggaguggaugggcggcaucagcccccuguucggcaccaccaacuacgcccagaaguuccagggcagagugaccaucaccgccgaccagagcaccaacaccaccuacauggaggugaacagccugagauacgaggacaccgccguguacuucugcgccagaggccccaaguacuacagcgaguacauggacguguggggcaagggcaccaccgugaccgugagcagc

SEQ ID NO: 35493 - RNA, 360 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggcaccuucagcagcuacgccaucagcugggugagacaggcccccggccagggccuggaguggaugggcggcaucaugggcauguucggcaccaccaacuacgcccagaaguuccagggcagagugaccaucaccgccgacgaguucaccagcgccgccuacauggagcugagaagccugagaagcgaggacaccgccguguacuacugcgccagaagcagcggcuacuaccccgaguacuuccaggacuggggccagggcacccuggugaccgugagcagc

SEQ ID NO: 35494 - RNA, 360 nt, Artificial Sequence
  derived and/or modified sequence opt4 from anti-influenza_Chain
cagaugcagcuggugcagagcggcgccgaggugaagaagcccggcagcagcgugaaggugagcugcaaggccagcggcggcaccuucagcagcuacgccaucaccugggugagacaggcccccggccagggccuggaguggaugggcggcaucaucggcauguucggcagcaccaacuacgcccagaacuuccagggcagagugaccaucaccgccgacgagagcaccagcaccgccuacauggagcugagcagccugagaagcgaggacaccgccguguacuacugcgccagaagcaccggcuacuaccccgccuaccugcaccacuggggccagggcacccuggugaccgugagcagc

SEQ ID NO: 35495 - RNA, 360 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaccuucagcagcuacggcaucagcugggugagacaggcccccggccagggccuggaguggaugggcgacaucaucggcauguucggcagcaccaacuacgcccagaacuuccagggcagacugaccaucaccgccgacgagagcaccagcaccgccuacauggagcugagcagccugagaagcgaggacaccgccguguacuacugcgccagaagcagcggcuacuaccccgccuaccugccccacuggggccagggcacccuggugaccgugagcagc

SEQ ID NO: 35496 - RNA, 360 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaccuucagcagcuacgccaucagcugggugagacaggcccccggccagggccuggaguggaugggcggcaucaucggcauguucggcaccgccaacuacgcccagaaguuccagggcagagugaccaucaccgccgacgaguucaccagcaccgccuacauggagcugagcagccugagaagcgaggacaccgccguguacuacugcgccagaggcaacuacuacuacgagagcagccuggacuacuggggccagggcacccuggugaccgugagcagc

SEQ ID NO: 35497 - RNA, 360 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggccccuucagaaacuucgccaucaacugggugagacaggcccccggccagggccuggaguggaugggcggcaucaucgccguguucggcaccaccaaguacgcccacaaguuccagggcagagugaccaucaccgccgacgacagcaccaacaccgccuacauggagcugggcagccugaagagcgaggacaccgccguguacuacugcgccagaggcccccacuacuacagcagcuacauggacguguggggcgagggcaccaccgugaccgugagcagc

SEQ ID NO: 35498 - RNA, 360 nt, Artificial Sequence
  derived and/or modified sequence opt4 from anti-influenza_Chain
gagguggcccugguggagaccggcgccgaggugaagaagcccggcagcagcgugaaggugcccugcaagagcagcggcagccccuucagaagcaacgccgugagcugggugagacaggcccccggccagggccuggagugggugggcggcauccugggcguguucggcagccccagcuacgcccagaaguuccagggcagagugaccaucaccgccgacgagagcaccaacaccgugcacauggagcugagaggccugagaagcgaggacaccgccguguacuacugcgccagaggccccaccuacuacuacagcuacauggacguguggggcaagggcaccaccgugaccgugagcagc

SEQ ID NO: 35499 - RNA, 360 nt, Artificial Sequence
  derived and/or modified sequence opt4 from anti-influenza_Chain
cagaugcagcuggugcagagcggcgccgaggugaagaagcccggcagcagcgugaaggugagcugcaaggccagcggcggcaccuucagcagcuacgccaucagcugggugagacaggcccccggccagggccuggaguggaugggcggcaucuucggcauguucggcaccgccaacuacgcccagaaguuccagggcagagugaccaucaccgccgacgaguucaccagcgccgccuacauggagcugagcagccugggcagcgaggacaccgccauguacuacugcgccagaagcagcggcuacuacccccaguacuuccaggacuggggccagggcacccuggugaccgugagcagc

SEQ ID NO: 35500 - RNA, 360 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcgugaccuucagcuacuacgccaugagcugggugagacaggcccccggccagggccuggaguggaugggcggcaucagccccauguucggcaccaccaccuacgcccagaaguuccagggcagagugaccaucaccgccgacgacagcaccagcaccgccuacauggaggugagaagccugagaagcgaggacaccgccguguacuacugcgccagaagcagcaacuacuacgacagcguguacgacuacuggggccagggcacccuggugaccgugagcagc

SEQ ID NO: 35501 - RNA, 360 nt, Artificial Sequence
  derived and/or modified sequence opt4 from anti-influenza_Chain
gaggugcagcugguggagaccggcgccgaggugaagaagcccggcagcagcgugaaggugcccugcaagagcagcggcagccccuucagaagcaacgccgugagcugggugagacaggcccccggccagggccuggagugggugggcggcauccugggcguguucggcagccccagcuacgcccagaaguuccagggcagagugaccaucaccgccgacgagagcaccaacaccgugcacauggagcugagaggccugagaagcgaggacaccgccguguacuacugcgccagaggccccaccuacuacuacagcuacauggacguguggggcaagggcaccaccgugaccgugagcagc

SEQ ID NO: 35502 - RNA, 360 nt, Artificial Sequence
  derived and/or modified sequence opt4 from anti-influenza_Chain
caggugcaccuggugcagagcggcgccgaggugagaaagcccggcgccagcgugaaggugagcugcaaggugagcggcuacacccugaacgagcugagcauccacuggcugagacaggcccccggcagaggccuggaguggaugggcagcuucgaccccgaggacggcgagaccaucuacgcccagaaguuccagggcagagugaccaugaccggcgacaccagcaccgacaccgccuaccuggagcugaccagccugagaagcgaggacaccgcccuguacuacugcgccagaggcuggggcgccgugaccagccccuucgacuucuggggccagggcacccuggugaccgugagcagc

SEQ ID NO: 35503 - RNA, 360 nt, Artificial Sequence
  derived and/or modified sequence opt4 from anti-influenza_Chain
gaggugcagcuggugcagagcggcgccgaggugaagaagcccggcagcagcaugaaggugagcugcaaggccagcggcagcaucuucagcaacuacggcaucagcugggugagacaggcccccggccagggccuggaguggaugggcggcaucauccccaucuucggcgccgccaacuacgcccagaaguuccagggcagagugaccaucaccgccgacgagagcaccagcaccguguacauggaggugagaagccugagaagcgaggacaccgccguguacuacugcgccagaagacagcagcuguacaagggcuacuaccaccacuggggccagggcacccuggugaccgugagcagc

SEQ ID NO: 35504 - RNA, 360 nt, Artificial Sequence
  derived and/or modified sequence opt4 from anti-influenza_Chain
caggugcagcuggugcagagcggcgccggcgugaagaagcccggcagcagcaugaaggugagcugcaaggccagcggcagcaucuucagcaacuacggcaucagcugggugagacaggcccccggccagggccuggaguggaugggcggcaucauccccaucuucggcgccgccaacuacgcccagaaguuccagggcagagugaccaucaccgccgacgagagcaccagcaccguguacauggaggugagaagccugagaagcgaggacaccgccguguacuacugcgccagaagacagcagcuguacaagggcuacuaccaccacuggggccagggcacccuggugaccgugagcagc

SEQ ID NO: 35505 - RNA, 360 nt, Artificial Sequence
  derived and/or modified sequence opt4 from anti-influenza_Chain
caggugcagcugcaggagagcggccccggccuggugaagcccagcgagacccugagccugaccugcaccgugagcggcggccugaucggcaccggcagcuacuacuggggcuggaucagacagacccccggcaagggcauggaguggaucggcagcaucagcuacagcggcagcaccuacuaccaccccagccugaagagcagagugaccaucagcgacgacaccagcaagaaccagcuguuccugaagcugagaagcgugaccgccgccgacaccgcccaguacuacugcgccagauacaacuggggcaucagauacuucgacuucuggggcagaggcacccuggugaccgugagcagc

SEQ ID NO: 35506 - RNA, 360 nt, Artificial Sequence
  derived and/or modified sequence opt4 from anti-influenza_Chain
caggugcagcuggugcagagcggcgccgaggugagaaagcccggcagcagcgugaaggugagcugcaaggugagcggcggcaucaucagaaaguacgccaucaacugggugagacaggcccccggccagggccuggaguggaugggcggcaucaucgccaucuucaacaccgccaacuacgcccagaaguuccagggcagagugaccaucaccgccgacgagagcaccagcaccguguacauggagcugagcagccugagaagcgaggacaccgcccuguacuacugcgccagaggcaugaacuacuacagcgacuacuucgacuacuggggccagggcagccuggugaccgugagcccc

SEQ ID NO: 35507 - RNA, 360 nt, Artificial Sequence
  derived and/or modified sequence opt4 from anti-influenza_Chain
caggugcagcuggugcagagcggcggcggcguggugcagcccggcagaagccugagacugagcugcgccgccagcggcuucaccuucagaagccacgccaugcacugggugagacaggcccccggcaagggccccgaguggguggcccugaucagcuacgacgaggugaacaaguucuacgccgacagcgugaagggcagauucaccaucagcagagacgugagcaagaacaccguguuccugcagaugaacagccugagcgccgacgacaccgccguguacuacugcgccagaggccacagcggcagcuacagacuguucgacuucuggggccagggcacccuggugaccgugagcagc

SEQ ID NO: 35508 - RNA, 360 nt, Artificial Sequence
  derived and/or modified sequence opt4 from anti-influenza_Chain
caggugcagcugguggagagcggcggcggccuggugcagcccggcggcagccugagacugagcugcgccgccagcggcuucaucuucggcgacuucgccauccacugggugagacaggccagcggcaagggccuggaguggguggccagaaucagaagcggccugaacagauucgagaccgccuacgccgccagcguggagggcagacugaccaucagcagagacgacagcaagagcauggccuaccugcagaugaacaacgugaaggccgaggacaccgccguguaccugugcaccuaccuggugggcgccgugggcuuccagcacuggggccagggcacccuggugaccgugagcagc

SEQ ID NO: 35509 - RNA, 360 nt, Artificial Sequence
  derived and/or modified sequence opt4 from anti-influenza_Chain
caggugcagcugguggagagcggcggcggcguggugcagcccggcagaagccugagacugagcugcgccgccagcggcuucaccuucagcagcuacggcaucuacugggugagacaggcccccggcaagggccuggaguggguggccuucaucagcuacgacgagaucaacaaguucuacgccgacagcgugaagggcagauucaccaucagcagagacaacagcaagaacaccguguuccugcagaugaacagccugagagacgaggacaccgccguguacuacugcgccaagccccugagaggcagcuacagauacuucgaccuguggggcagaggcaccguggugaccgugagcagc

SEQ ID NO: 35510 - RNA, 363 nt, Artificial Sequence
  derived and/or modified sequence opt4 from anti-influenza_Chain
caggugcagcugcaggagagcggccccgaccuggugaagcccggcgccagcgugaugaucagcugcaaggccagcggcuacagcuucaccuacuacuacaugcacugggugaagcagagccacggcaagacccuggaguggaucggcagaaucuaccccuacaacggcgacaccaacuacaacagaagauucaaggacaaggccauccugaccguggacgagagcagcagcaccgccuacauggagcugagaagccugaccagcgaggacagcgccguguacuucugcgccagagacgccaacuacgagggcgacugguacuucgacguguggggccagggcaccaccgugaccgugagcagc

SEQ ID NO: 35511 - RNA, 363 nt, Artificial Sequence
  derived and/or modified sequence opt4 from anti-influenza_Chain
caggugcagcuggugcagagcggcggcggcguggugcagcccggcagaagccugagacugagcugcgccgccagcggcuucaccuucagcagcuacgccaugcacugggugagacaggcccccggcaagggccuggaguggguggccaucaucagcuacgacggcaacgaccaguacuacaccgacagcgugaagggcagauucaccaucagcagagacagcagcaagguguaccugcagaugcacagacugagacccgaggacaccgccguguacuacugcgccaaggaguucgagaccagcggcuacuuccacggcagcuucgacuacuggggccagggcauccuggugaccgugagcagc

SEQ ID NO: 35512 - RNA, 363 nt, Artificial Sequence
  derived and/or modified sequence opt4 from anti-influenza_Chain
caggugcagguggugcagagcggcgccgaggugaagaagcccggcagcagcgugagagugagcugccaggccagcggcggcaccuucaugaacuacgccaucaucugggugagaagagcccccggccagggccuggaguggaugggcggcaucauccccguguuccccacccccaacuacgcccagauguuccagggcagagugaccaucagcaccgacgagagcagaagcaccagcuuccuggagcugaccaaccugagauacgaggacaccgccguguacuacugcgccagaagaaucuaccacggcggcaacagcggcuucgacuucuggggccagggcacccuggugaccgugagcagc

SEQ ID NO: 35513 - RNA, 363 nt, Artificial Sequence
  derived and/or modified sequence opt4 from anti-influenza_Chain
caggugcagcugcaggagagcggccccggccugcugaagcccagcgacacccuggcccugaccugcaccgugagcggcggcagcaucaccagcgacuacuggagcuggaucagacagccccccggcagaggccuggacuggaucggcuucuucuacaacggcggcagcaccaaguacaaccccagccugaagagcagagugaccaucagcgccgacaccagcaagaaccagcugagccugaagcugaccagcgugaccgccgccgacaccggcguguacuacugcgccagacacgacgccaaguucagcggcagcuacuacguggccagcuggggccagggcaccagagugaccgugagcagc

SEQ ID NO: 35514 - RNA, 363 nt, Artificial Sequence
  derived and/or modified sequence opt4 from anti-influenza_Chain
caggugcagcugcaggagagcggccccggccugcugaagcccagcgacacccuggcccugaccugcaccgugagcggcggcagcaucaccagcgacuacuggagcuggaucagacagccccccggcagaggccuggacuggaucggcuucuucuacaacggcggcagcaccaaguacaaccccagccugaagagcagagugaccaucagcgccgacaccagcaagaaccagcugagccugaagcugaccagcgugaccgccgccgacaccggcguguacuacugcgccagacacgacgugaaguucagcggcagcuacuacguggccagcuggggccagggcaccagagugaccgugagcagc

SEQ ID NO: 35515 - RNA, 363 nt, Artificial Sequence
  derived and/or modified sequence opt4 from anti-influenza_Chain
caggugcagcugcaggagagcggccccggccuggugaagcccagcgagacccugagcgugaccugcaaggugagcggcgacagcaucagcagcuacagcuggagcuggaucagacagccccccggcaagggccuggagugggugggcuaccuguacuacagcggcagcaccaaguacaaccccagccugaagagcagaaccaccaucagcguggacaccagcaccaaccagcugagccugaagcugagcuucgugaccgccgccgacaccgccguguacuucugcgccagaaccggcagcgagagcaccaccggcuacggcauggacguguggggccagggcaccaccgugaccgugagcagc

SEQ ID NO: 35516 - RNA, 363 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagc

SEQ ID NO: 35517 - RNA, 363 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagc

SEQ ID NO: 35518 - RNA, 363 nt, Artificial Sequence
  derived and/or modified sequence opt4 from anti-influenza_Chain
gaggugcagcugguggagaccggcgccgaggugaagaagcccggcgccagcgugaaggugagcugcaaggccagcggcuacaccuucaccagcuacuacaugcacugggugagacaggcccccggccagggccuggaguggaugggcuggaucaaccccaacagcggcggcaccaacuacgcccagaaguuccagggcagagugaccaugaccagagacaccagcaucagcaccgccuacauggagcugagcagacugagaagcgacgacaccgccguguacuacugcgccagagagggcaaguggggcccccaggccgccuucgacaucuggggccagggcaccauggugaccgugagcagc

SEQ ID NO: 35519 - RNA, 363 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaccuucagcuucuacagcaugagcugggugagacaggcccccggccagggccuggaguggaugggcggcaucauccccauguucggcaccaccaacuacgcccagaaguuccagggcagagugaccaucaccgccguggagagcaccagcaccgccuacauggaggugagcagccugagaagcgaggacaccgccguguacuacugcgccagaggcgacaagggcaucuacuacuacuacauggacguguggggcaagggcaccaccgugaccgugagcagc

SEQ ID NO: 35520 - RNA, 363 nt, Artificial Sequence
  derived and/or modified sequence opt4 from anti-influenza_Chain
gaggugcagcugguggagaccggcgccgaggugaagaagcccggcagcagcgugaaggugagcugcaaggccagcggcggcaccuucagaacccacgccaucagcugggugagacaggcccccggccagggccuggaguggaugggcggcaucaucgccaucuucggcaccgccaacuacgcccagaaguuccagggcagaaucaccaucaccgccgacgagagcaccagcaccgccuacauggagcugagcagccugagaagcgaggacaccgccguguacuucugcgccagaggcagcggcuaccacaucagcacccccuucgacaacuggggccagggcacccuggugaccgugagcagc

SEQ ID NO: 35521 - RNA, 363 nt, Artificial Sequence
  derived and/or modified sequence opt4 from anti-influenza_Chain
gaggugcagcuggugcagagcggcgccgaggugaagaagcccggcagcagcgugaaggugagcugcaaggccagcggcggcaucuucagaagcaacagcaucagcugggugagacaggcccccggccagggccuggaguggaugggcggcaucuucgcccuguucggcaccaccgacuacgcccagaaguuccagggcagagugaccaucaccgccgacgagagcagcaccaccguguaccuggagcugagcagccugaccagcgaggacaccgccguguacuacugcgccagaggcagcggcuacaccaccagaaacuacuucgacuacuggggccagggcacccuggugaccgugagcagc

SEQ ID NO: 35522 - RNA, 363 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaucuucaacagcuacgccaucagcugggugagacaggcccccggccagggccuggaguggaugggcggcaucaucgccaucuuccacacccccaaguacgcccagaaguuccagggcagagugaccaucaccgccgacgagagcaccaacaccgccuacauggagcugagaagccugaagagcgaggacaccgcccuguacuacugcgccagaggcagcaccuacgacuucagcagcggccuggacuacuggggccagggcacccuggugaccgugagcagc

SEQ ID NO: 35523 - RNA, 363 nt, Artificial Sequence
  derived and/or modified sequence opt4 from anti-influenza_Chain
caggugcagcuggugcagagcggcgccgaggugaagaagcccggcagcagcgugaaggugagcugcaagagcagcggcggcaacuucaacaacuacgccgugagcugggugagacaggcccccggccagggccuggaguggaugggcggcaucagccccaucuucggcagcaccaaccacgcccagaaguuccagggcagagugaccaucagcgccgacaucuucaccaacaccgccuacauggagcugagcagccugagaagcgacgacaccgccaucuacuacugcgccagaggcagaggcuacuacuucuaccacgccauggacguguggggccagggcagcaccgugaccgugagcagc

SEQ ID NO: 35524 - RNA, 363 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggcaccuucaacaacuacgccaucaacugggugagacaggcccccggccagggccuggaguggaugggcggcaucagccccaucuucggcagcgugaacuacgcccagaagcugcagggcagagugaccaucaccgccgacguguucaccagcaccgccuacauggagcugagcagccugagaagcgaggacaccgccguguacuacugcgccaagggcagcggcuacuacuacuacuacggccuggacguguggggccugggcaccaccgugaccgugagcagc

SEQ ID NO: 35525 - RNA, 363 nt, Artificial Sequence
  derived and/or modified sequence opt4 from anti-influenza_Chain
caggugcagcugguggagagcggcggcggcguggugcagcccggcagaagccugagacugagcugcgccgccagcggcuucaccuucaccaacuacgccaugcacugggugagacaggcccccggcaagggccuggaguggguggccgugaucagcuucgacgaggacaacaagagcuacgccgacuacgugaagggcagauucaccaucagcagagacaacagcaacaacagacuguaccugcagaugaacagccugagagccgaggacaccgccguguacuacugcgccagaggccccgagggcguguggggcagaagcaucgacagcuggggccagggcacccuggugaccgugagcagc

SEQ ID NO: 35526 - RNA, 363 nt, Artificial Sequence
  derived and/or modified sequence opt4 from anti-influenza_Chain
caggugcagcuggugcagagcggcggcgaccuggugcagcccggcggcagccugagacugagcugcgccgccagcggcuucaccuucagcagauacagcaugaacugggugagacaggcccccggcaugggccuggaguggguggccuacaucagcgacaccagcagaaccaucuacuacgccgacagcgugaagggcagauucaccaucagcagagacaacgccaagaacagccuguaccugcagaugaagagccugagagacgaggacaccgccguguacuacugcgccagagaccccgacacccccuucgugagagccuucgacagcuggggccagggcacccuggugaccgugagcagc

SEQ ID NO: 35527 - RNA, 363 nt, Artificial Sequence
  derived and/or modified sequence opt4 from anti-influenza_Chain
caggugcagcugguggagagcggcggcggccuggugcagcccggcggcagccugagacugagcugcguggccagcggcuucaccuucagcagauucagcaugaacugggugagacaggcccccggcaugggccuggagugggugagcuacaucagcgacaccggcagaaccaucuacuacgccgacagcgugaagggcagauucaccaucagcagagacaacgacaagaacacccuguaccugcagaugaagagccugagagacgaggacagcgccuucuacuacugcgccagagaccccgacacccccuucgugagagccuucgacagcuggggccagggcgugcuggugaccgugagcagc

SEQ ID NO: 35528 - RNA, 363 nt, Artificial Sequence
  derived and/or modified sequence opt4 from anti-influenza_Chain
caggugcagcugcaggagagcggccccgaccuggugaagcccggcgccagcgugaagaugagcugcaaggccagcggcuacagcuucaccuacuaccacaugcacugggugaagcagacccacggcaagagccuggaguggaucggcagaaucuaccccuacaacggcggcaccaacuacagccagagauucaagggcaaggccguguucaccguggacaugagcagcagcaccgccuacauggagcugagaagccugaccagcgaggacagcgccguguacuacugcgccagagacgccaacuacgagggcgacugguacuucgacguguggggccagggcaccaccgugaccgugagcagc

SEQ ID NO: 35529 - RNA, 366 nt, Artificial Sequence
  derived and/or modified sequence opt4 from anti-influenza_Chain
cagggccagcuggugcagagcggcgccgaggugaagaagagcggcagcagcgugaaggugagcugcaagaccagcggcggcaccuucaacagccacgccaucagcugggugagacaggcccccggccagggccuggaguggaucggcggcaucauccccauguucggcaccaccaacuacgcccagaagcugaagggcagaaucgccaucaccgccgaccagcugcccaccaccgccuaccuggagcugagcagccugagaagcgaggacaccgccguguacuacugcgccagaggccagagauacuacuacgacagagacggcauggacguguggggccagggcaccauggugaccgugagcagc

SEQ ID NO: 35530 - RNA, 366 nt, Artificial Sequence
  derived and/or modified sequence opt4 from anti-influenza_Chain
caggugcaccuggugcagagcggcgccgaggugaagaagcccggcagcagcgugagacugagcugcagcgccagcggcggccccuucagcggcuucgccaucagcuggcugagacaggcccccggccagggccuggaguggcugggcggcaucagcgccguguucggcaccgccaccuacgcccagaaguuccagggcagagugaccaucaccgccgaccaguucaccagcaccagccacauggaccugagcagacugaccuacgacgacaccgccguguacuacugcgccagaagcggcggcuaccugccccagaacaacuggaucgaccccuggggccagggcacccuggugaucgugagcagc

SEQ ID NO: 35531 - RNA, 366 nt, Artificial Sequence
  derived and/or modified sequence opt4 from anti-influenza_Chain
caggugcagcuggugcagagcggcgccgaggugaagaaggccggcagcagcgugaaggugagcugccagagcagcggcgugaccuucagcauguacgccgugagcugggugagacaggcccccggccagggccuggaguggaugggcggcaucaucccccuguucggcaccaccaccuacgcccagaaguucgagggcagacugaccaucaccgccgacaccagcaccaacauggccuaccuggagcugagaagccugagaagcgaggacaccgccguguacuucugcgccagagccggcaccaccgugaccagauucaacugguucgaccccuggggccagggcacccuggugaccgugagcagc

SEQ ID NO: 35532 - RNA, 366 nt, Artificial Sequence
  derived and/or modified sequence opt4 from anti-influenza_Chain
caggugcagcuggugcagagcggcgccgaggugaagaagcccggcagcagccugaaggugagcugcaaggccagcggcgugaccuucagcauguacaccaucagcugggugagacaggcccccggccagggccuggaguggaugggcggcaucaucccccuguucggcaccgccaacuacgagcagaaguuccagggcagagugaccaucaccgccgacaccagcaccaacaccgccuacauggagcugagcagccugagaagcgaggacaccgccguguacuacugcgccagagccggcaccacccugaccagauucaacugguucgaccccuggggccagggcacccuggugaccgugagcagc

SEQ ID NO: 35533 - RNA, 366 nt, Artificial Sequence
  derived and/or modified sequence opt4 from anti-influenza_Chain
auggccgacaacaugaccaccacccagaucgaguggagaaugaagaagauggccaucggcagcagcacccacagcagcagcgugcugaugaaggacauccagagccaguucgagcagcugaagcugagaugggagagcuaccccaaccuggugaagagcaccgacuaccaccagaagagagagaccaucagacuggccaccgaggagcuguaccugcugagcaagagaaucgacgacagcauccuguuccacaagaccgugaucgccaacagcagcaucaucgccgacaugaucgugagccugagccugcuggagacccuguacgagaugaaggacgugguggagguguacagcagacagugccug

SEQ ID NO: 35534 - RNA, 366 nt, Artificial Sequence
  derived and/or modified sequence opt4 from anti-influenza_Chain
gaggugcagcuggugcagagcggcggcggccuggugcagcccggcggcagccugagacuggccugcguggugagcggcuucaccgugaccagcaacuacaucaccugggugagacaggcccccggcaagggccuggagugggugagcgugaucuacagccacggcagagccuacuacagcgccagcgugaacggcagauucaccaucagcagacacaccagcaagaacaccguguaccuggagaugaacagccugagacccgaggacaccgccguguacuacugcgccggcggcggccuggugggcggcuacgacgaguacuucuucgacuacuggggccagggcacccuggccaccgugagcagc

SEQ ID NO: 35535 - RNA, 366 nt, Artificial Sequence
  derived and/or modified sequence opt4 from anti-influenza_Chain
caggugcagcuggugcagagcggcgccgaggugaagaagcccggcgccagcgugaaggugagcugcaaggccagcggcuacaccuucaccggcuacuacaugcacugggugagacaggcccccggccagggccuggaguggaugggcuggaucaaccccaacagcggcgacaccaacuacgcccagaaguuccagggcagagugaccaugaccagagacaccagcaucaccaccgccuacauggagcugagcagccugagaagcgacgacaccgccguguacuacugcgccagagacagccccuacagcagcagcuggagcuucuucgacuacuggggccagggcccccuggugaccgugagcagc

SEQ ID NO: 35536 - RNA, 366 nt, Artificial Sequence
  derived and/or modified sequence opt4 from anti-influenza_Chain
gaggugcagcugguggagagcggcggcggccuggugcagcccggcggcagccugagacugagcugcgccgccagcggcuucaucuucagaaacuacuggaugagcugggugagacaggcccccggcaagggccuggaguggguggccaacaucaagcaggacggcagagagaaguacuacguggacagccugagaggcagagugaacaucagcagagacaacgccgagaacagccuguaccugcacaugaacagccugagaguggaggacaccgccguguacuucugcgccagagccagaauggugguggugaccggcgacggcuucgacguguggggccacggcaccauggugaccgugagcagc

SEQ ID NO: 35537 - RNA, 366 nt, Artificial Sequence
  derived and/or modified sequence opt4 from anti-influenza_Chain
gaggugcagcugcuggagagcggcggcggccuggugcagcccggcggcagccugagacugagcugcgccgccagcggcuucgccuucagcagcuacggcaugagcugggugagacaggcccccggcaagggccuggagugggugagcgccuucagcggcagcggcaccagcaccuacuacgccgacagcgugaagggcagauucaccaucagcagagacaagagcaagaacacccuguaccugcagaugaacagccugagagccgaggacaccgccaucuacuacugcgccaagccccccggccccuacaucgugguggccggccuguucgagaacuggggcagaggcacccuggugaccgugagc

SEQ ID NO: 35538 - RNA, 366 nt, Artificial Sequence
  derived and/or modified sequence opt4 from anti-influenza_Chain
gaggugcagcugguggagagcggcggcggcguggugcagcccggcagaagccugagacugagcugcgccgccagcggcuucagcuucagcaacuacgccaugcacugggugagacaggcccccggcaagggccuggaguggguggcccugaucagcuucgacggcagcgacaaguacuacgccgacagcgugaagggcagauucaccaugagcagagacaacagcaagaacacccuguaccugcagaugaacagccugagagccgaggacaccgccguguacuacugcgccagagacgagcccuacugcggcggcgacugcuucgccuucgacguguggggccagggcaccauggugaccgugagc

SEQ ID NO: 35539 - RNA, 366 nt, Artificial Sequence
  derived and/or modified sequence opt4 from anti-influenza_Chain
caggugcagcugcagcagagcggccccggccuggugaagcccagccagacccugagccugaccugcaccgugagcggcggccccgugagcggcggcggcuacagcuggaacuggaucagacagagacccggccagggccuggagugggugggcuucauguuccacagcggcagccccagauacaaccccacccugaagagcagaaucaccaucagcguggacaccagcaagaaccuggugagccugaagcugagcagcgugaccgccgccgacaccgccguguacuucugcgccagagugggccagauggacaaguacuacgccauggacguguggggccagggcaccaccgugaccgugagcagc

SEQ ID NO: 35540 - RNA, 366 nt, Artificial Sequence
  derived and/or modified sequence opt4 from anti-influenza_Chain
caggugcagcuggugcagagcggcggcggccuggugaagcccggcggcagccugagacugagcugcgccgccagcggcuucaccuucagcagcuacagcaugaacugggugagacaggcccccggcaagggccuggagugggugagcagcaucagcagcagcagcagcuacaucuacuacguggacagcgugaagggcagauucaccaucagcagagacaacgccaagaacagccuguaccugcagaugaacagccugagagccgaggacaccgccguguacuacugcgccagaggcggcggcagcuacggcgccuacgagggcuucgacuacuggggccagggcacccuggugaccgugagcagc

SEQ ID NO: 35541 - RNA, 366 nt, Artificial Sequence
  derived and/or modified sequence opt4 from anti-influenza_Chain
caggugcagcuggugcagagcggcggcggcguggugcagcccggcagaagccugagacugagcugcgccgccagcggcuucaacuucagcagcuacggcaugcacugggugagacaggcccccggcaagggccuggaguggcugagcgugaucuggagcggcggcagcaacaaguacuacgccgacagcgugaagggcagauucaccaucagcagagacgacagcaagaacaccguguaccugcagaugaacagccugagagacgaggacaccgccguguacuacugcgccagagcccacaccgcccugaccagauucagauggcuggaccccuggggccagggcauccuggugaccgugagcagc

SEQ ID NO: 35542 - RNA, 366 nt, Artificial Sequence
  derived and/or modified sequence opt4 from anti-influenza_Chain
caggugcagcuggugcagagcggcggcggcguggugcagagaggcagaagccugagacugagcugcgccgccagcggcuucaccuucagaaccuacggcaugcacugggugagacaggcccccggcaagggccuggagugcguggcccugaucagcuacgacggcaccaacaaguacuacgccgacagcgugaagggcagauucaccaucagcagagacaacagcaaggacacccuguaccugcagaugaacagccugagagccgaggacaccggcguguacuacugcgccagccuggacuacgacuucagcuacuacuaccacagagacguguggggccccggcaccaccgugaccgugagcagc

SEQ ID NO: 35543 - RNA, 366 nt, Artificial Sequence
  derived and/or modified sequence opt4 from anti-influenza_Chain
caggugcagcugguggagagcggcggcggccuggugcagcccggcggcagccugagacugagcugcgccgccagcggcuucaccuucagcgacuacuggauggugugggugagacaggcccccggcaagggccuggugugggugagcagaaucagcagcgacggcagcaccaccagcuacgccgacagcgugaagggccccuucaccaucagcagagacaacgccaagaacacccuguaccugcagaugaacagccugagagccgaggacaccgccguguacuacugcgccagaguggccacccccuacuacuacgagagcggcuucgacuacuggggccagggcgcccuggugaccgugagcagc

SEQ ID NO: 35544 - RNA, 369 nt, Artificial Sequence
  derived and/or modified sequence opt4 from anti-influenza_Chain
caguuccagcuggugcagagcggccccgaggugaagaagcccggcaccagcgugaaggugagcugcaaggccagcggcuacaccagcaccaccuacggcaucagcugggugagacaggugcccggccagggccuggaguggaugggcuggaucaaccccuacaacggcaacccccacuacggccagaaguuccagggcagagugacccugaccagagacaccagcaccaacaccgccuaccuggagauccugagccugagaagcgacgacaccgccguguacuacugcgccagagacggcuggggccagcagcuggugcccuacuacuucgacuacuggggccagggcacccuggugaccgugagcagc

SEQ ID NO: 35545 - RNA, 369 nt, Artificial Sequence
  derived and/or modified sequence opt4 from anti-influenza_Chain
caggugcagcuggcccagagcggcgccgaggugaagagacccggcagcagcgugaaggugagcugcaccgccagcggcggcaucuucagaaagaacgccaucagcugggugagacaggcccccggccagggccuggaguggaugggcggcaucaucgccguguucaacaccgccaacuacgcccagaaguuccagggcagagugaagaucaccgccgacgagagcggcaacaccgccuacauggagcugagcagccugagaagcgacgacaccgccguguacuacugcgccagccaccccaaguacuucuacggcagcggcagcuaccccgacuucuggggccagggcacccuggugaccgugagcagc

SEQ ID NO: 35546 - RNA, 369 nt, Artificial Sequence
  derived and/or modified sequence opt4 from anti-influenza_Chain
caggugcagcugcaggagagcggccccggccuggugaagcccagcgagacccugagccugaccugcaccgugagcagaggcagcaucggccacuacuucuggagcuggaucagacagccccccggcaagggccuggaguggaucggcuacaucagcuacagcggcagcaccaaguacaaccccagccugagaagcagagugaccaucagcguggacaccagcaagaaccaguucagccugaaccugaacagcgugaccgccaccgacaccgcccuguacuacugcgccagagaggacuacgacauccugaccggcgccggccccggcauggagguguggggccagggcaccaccgugaccgugagcagc

SEQ ID NO: 35547 - RNA, 369 nt, Artificial Sequence
  derived and/or modified sequence opt4 from anti-influenza_Chain
caggugcagcugcaggagagcggccccggccuggugaagcccagcgagacccugagccugaccugcaccgugagcggcgccagcaucaacagccacuacuggagcuggaucagacagccccccggcaagggccuggaguggaucggcuacguguacuacagcggcagcaccaccuacaaccccagccugaagagcagagugacccugagcguggacaccagcaagaaccaguucagccugaaccugagcagcgugaccgccgccgacaccgccuucuacuacugcgccagacaccccuacgacgugcugaccggcagcggcgacugguucgaccccuggggccagggcacccuggugaccgugagcagc

SEQ ID NO: 35548 - RNA, 369 nt, Artificial Sequence
  derived and/or modified sequence opt4 from anti-influenza_Chain
caggugcagcuggugcagagcggcgccgaggugaagagacccggcagcagcgugaaggugagcugcaccgccagcggcggcaucuucagaaagaacgccaucagcugggugagacaggcccccggccagggccuggaguggaugggcggcaucaucgccguguucaacaccgccaacuacgcccagaaguuccagaacagagugaagaucaccgccgacgagagcggcaacaccgccuacauggagcugagcagccugaccagcgacgacaccgccguguacuacugcgccagccaccccaaguacuucuacggcagcggcagcuaccccgacuucuggggccagggcacccuggugaccgugagcagc

SEQ ID NO: 35549 - RNA, 369 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaccuucagaagcuacgccgugagcugggugagacaggcccccggccagggccuggaguggaugggcggcaucaucgccaucuucggcaccaccaacuacgcccagaaguuccaggacagagugaccaucaccgccgacgaccugcccagcaccgccuacauggagcugaccagccugagaagcgaggacaccgccguguacuucugcgugagaggcagaggcuacuaccugggcggcgacuacggcagccuggacagcuggggccagggcacccuggugaccgugagc

SEQ ID NO: 35550 - RNA, 369 nt, Artificial Sequence
  derived and/or modified sequence opt4 from anti-influenza_Chain
gaggugcagcugguggagagcggcggcggccuggugcagcccggcagaagccugagacugagcugcgugggcagcggcuucaacuucgacggcuacgccaugcagugggugagacaggugcccggcaagggccuggagugggugagcggcaucagcuggcacagcgacagcaccggcuacgccgacagcgugagaggcagauucaccaucagcagagacaacgccaagaacagccuguaccugcagauggacagccugagacccgaggacaccgccuucuacuacugcggcaagagcaucggccacgugggcggcagcuacagacaccccaucgacuacuggggccagggcacccuggugaccgugagc

SEQ ID NO: 35551 - RNA, 369 nt, Artificial Sequence
  derived and/or modified sequence opt4 from anti-influenza_Chain
caggugcagcugcaggccagcggccccggccuggugaagcccagcgagacccugagccugaccugcaccgugagcggcgacagcaucaccagcggcgccuacuacuggaccuggaucagacagcaccccggcaagggccuggaguggaucggcuacaucuacuacagcggcaacaccuacuacaaccccagccugaagagcagagugaccaucagccuggacaccagcaagaaccaguucagccugaaggugaacagcgugaccgccgccgacaccgccguguacuacugcgccagagccgccagcaccagcgugcugggcuacggcauggacguguggggccagggcaccaccgugaccgugagcagc

SEQ ID NO: 35552 - RNA, 369 nt, Artificial Sequence
  derived and/or modified sequence opt4 from anti-influenza_Chain
caggugcagcuggugcagagcggcgccgaggugaagaagcccggcagcagcgugagagugagcugcaaggccagcggcagcaucuucagaaacuacgccaugagcugggugagacaggcccccggccagggccuggaguggaugggcggcaucaucgccaucuucggcacccccaaguacgcccagaaguuccagggcagagugaccaucaccgccgacgagagcaccagcaccguguacauggagcugagcggccugagaagcgaggacaccgccauguacuacugcgccagaaucccccacuacaacuucggcagcggcagcuacuucgacuacuggggccagggcacccuggugaccgugagcagc

SEQ ID NO: 35553 - RNA, 369 nt, Artificial Sequence
  derived and/or modified sequence opt4 from anti-influenza_Chain
cagcugcagcugcaggagagcggccccagacuggugaagcccagcgagacccugagccugaccugcagcgugagcggcgugagcaucagcagcagcaacuacuacuggggcuggaucagacagccccccggcaagggccuggaguggaucggcaccaucuaccacagcggcagcaccuacuacaaccccagccugaagagcagacugaucaucagcguggacaccagcaagaaccaguucuaccugcagcugaccagccugaccgccgccgacagcgccguguacuacugcgccaccggcggcggcuucggcuggagccagaccuacuucggcuacuggggccagggcacccuggugaccgccagcagc

SEQ ID NO: 35554 - RNA, 369 nt, Artificial Sequence
  derived and/or modified sequence opt4 from anti-influenza_Chain
gaggugcagcugcagcagagcggccccgagcuggugaagcccggcgccagcgugaagaugagcugcaaggccagcggcuacaccuucaccagcuucaucauguacugggugaagcagaagcccggccagggccuggaguggcugggcuacaucgaccccuacaacgacggcaccaaguacaacgagaaguucgagggcaaggccacccugaccagcgacaagagcagcagcaccgccuacauggagcugagcagccugaccagcgaggacagcgccguguacuacugcgccaagagaggcaacuacggcaacggcuucgccuacuggggccagggcacccuggugaccgugagcgccgccaagaccagc

SEQ ID NO: 35555 - RNA, 369 nt, Artificial Sequence
  derived and/or modified sequence opt4 from anti-influenza_Chain
caggugcagcugcuggagagcggcggcgacguggugcagcccggcaccagccugagacugagcugcgccgccagcggcuucagccuguggaccagcggcaugcacugggugagacaggcccccggcaagggccuggaguggguggccgugaugagcuacgacgagaccaagaaguacuacgccgacagcgugagaggcagauucagcaucagcagagacaacagcagaaacacccuguaccugcagaugaacagccugagaguggaggacaccgccguguacuucugcgccaagcccagacuggacuaccuggacuacuuccacgccgccgacagcuggggccagggcacccuggugagcgugagcagc

SEQ ID NO: 35556 - RNA, 369 nt, Artificial Sequence
  derived and/or modified sequence opt4 from anti-influenza_Chain
caggugcagcugguggagagcggcgccgaggugagaaagcccggcgagagccugagaaucagcugcaaggcccacggcgacagcuucaccagcuacuggaucggcugggugagacagcugcccggcaagggccuggaguggauggccgugaucuaccccagagacagcgagaccaaguucagccccgccuuccacggccaggugagcaucagcguggacaagagcaccagcaccgugcaccugcaguggaacagccugaaggccagcgacaccgccguguacuacugcgccagaagccccggcuacagcggcuaccuguacggcugguucgaccccuggggccagggcacccccgugaccgugagcagc

SEQ ID NO: 35557 - RNA, 369 nt, Artificial Sequence
  derived and/or modified sequence opt4 from anti-influenza_Chain
caggugcagcugguggagagcggccccggccuggugaagcccagcgagacccugagccugaccugcaccgugagcggcgacagcgugaucaacagcgccuacuacugggacuggaucagacagccccccggcaagggccuggagugggugggcagcguguacuacagcggcaucaccuacuacaaccccagccugaagagcagagugaccaucagcguggacaccagcaagaaccaguucagccugagacugagcuacgugaccgccgccgacaccgcccuguacuacugcgccagaagaggcggcggcuggcaguacuacuacggcauggacguguggggccagggcaccaccgugaccgugagcagc

SEQ ID NO: 35558 - RNA, 369 nt, Artificial Sequence
  derived and/or modified sequence opt4 from anti-influenza_Chain
caggugcagcuggugcagagcggcgccgaggugaagaagcccggcgccagcgugaaggugagcugcaaggccagcggcuacaucuucaccggcuacuacauccacugggugagacaggcccccggccagggccuggaguggaugggcagaaucgaccccaacggcagcggcaccaccuacgcccagaaguuccagggcagagugacccugaccauggacaccagcaucaccaccgccuacauggagcugagcagacugagauucgacgacaccgccaucuacuacugcgccagaugggacuggaacuucgaccuguaccugggcugguucgaccccuggggccagggcacccccgugaccguggccagc

SEQ ID NO: 35559 - RNA, 369 nt, Artificial Sequence
  derived and/or modified sequence opt4 from anti-influenza_Chain
gaggugcagcuggugcagagcggcgccgaggugaagaagcccggcgccagcgugaaggugagcugcaaggccagcggcuacaucuucaccggcuacuacauccacugggugagacaggcccccggccagggccuggaguggaugggcagaaucgaccccaacggcgccggcaccaccuacgcccagaaguuccagggcagagugacccugaccauggacaccagcaucaccaccgccuacauggagcugagcagacugagauucgacgacaccgccaucuacuacugcgccagaugggacuggaacuucgaccuguaccugggcugguucgaccccuggggccagggcacccccgugaccguggccagc

SEQ ID NO: 35560 - RNA, 369 nt, Artificial Sequence
  derived and/or modified sequence opt4 from anti-influenza_Chain
caggugcagcuggugcagagcggcgccgaggugaagaagcccggcgccagcgugaaggugagcugcaaggccagcggcuacaccuucaacgcccaccacaugcacugggugagacaggcccccggccagggccugggcuggaugggcuggaucgaccccaacaacgacggcaccaucuacgcccagaaguuccagggcagagugacccugaccauggacaccagcauccacaccgccuacauggagcugagcggccugagauacgacgacaccgccaucuacuacugcgugagaugggccuggaacuucgacuucuuccugggcugguucgaccccuggggccagggcacccuggugaccguggccagc

SEQ ID NO: 35561 - RNA, 369 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgacagcgacaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagc

SEQ ID NO: 35562 - RNA, 369 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgacgccgacgccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagc

SEQ ID NO: 35563 - RNA, 369 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgagagcgagaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagc

SEQ ID NO: 35564 - RNA, 369 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgacgccgacaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagc

SEQ ID NO: 35565 - RNA, 369 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcagcagcgacaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagc

SEQ ID NO: 35566 - RNA, 369 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgacagcgacgccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagc

SEQ ID NO: 35567 - RNA, 369 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgacaccgacaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagc

SEQ ID NO: 35568 - RNA, 369 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgagagcgacaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagc

SEQ ID NO: 35569 - RNA, 372 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggcaucuucaucagccaggccaucagcugggugagacaggcccccggccagggccuggaguggaugggcggcaucauccccauguucggcgccaccaacuacgcccagaaguuccagggcagagugaccaucaccgccgacaagagcaccaacaccguguacauggagcugagcagccugaccagcgaggacaccgccguguacuacugcgccagacugggcagcggcagcuaccacaacggccccaacugguucgaccccuggggccagggcacccuggugaccgugagcagc

SEQ ID NO: 35570 - RNA, 372 nt, Artificial Sequence
  derived and/or modified sequence opt4 from anti-influenza_Chain
caggugcagcugcaggagagcggccccggccuggugaagcccagcgagacccugagccugaacugcgccgugagcggcggcagcaucagcaacuacuacuggagcuggaucagacagccccccggcaagggccuggaguggaucggcuacaucagcuacaacggcagacccaaguacaaccccagccugaccagcagagugaccaucagcguggacaccagcaaggaccaguucagccuggagcugagaagcgugaccgccgccgacaccgcccuguacuacugcgccagagagaccagauucggcgagcugcugagccccuacgacgccuucgagaucuggggccagggcaccauggugaccgugagcagc

SEQ ID NO: 35571 - RNA, 372 nt, Artificial Sequence
  derived and/or modified sequence opt4 from anti-influenza_Chain
caggugcagcugcaggagagcggccccggccuggugaagcccagcgagacccugagccugaccugcaccgugagcggcggcagcgugagcagcgagaccuacuacuggagcuggaucagacagccccccggcaagggccuggaguggaucggcuacaucuacuacaucggcaacaccgacuacagacccagccugaagagcagagugaccaucagccuggacaccagcaagaaccaguucagccugaagcugagcagcgugaccgccgccgacaccgccguguacuacugcgccagaggcgccuacuacgacagcagcggcuaccccgccuucuacaucuggggccagggcaccauggugaccgugagcagc

SEQ ID NO: 35572 - RNA, 372 nt, Artificial Sequence
  derived and/or modified sequence opt4 from anti-influenza_Chain
caggugcagcugcaggagagcggccccggccuggugaagcccagcgagacccugagccugaccugcgccgugagcggcgugagcaucagcaacaucgacuucuacuggggcuggaucagacagccccccggcaagggccuggaguggaucggcaacaucuacuacaccggcaucaccuucuacaaccccagccugagcagcagaguggccaucagcaucgacaccagcaagaaccaguucagccugacccugaccagcgugaccgccgccgacaccgccauguacuacugcgccagacacuacggcgacagcgaggccaucaacgacgccuucgacaucuggggccagggcaccaugcugaccgugagcagc

SEQ ID NO: 35573 - RNA, 372 nt, Artificial Sequence
  derived and/or modified sequence opt4 from anti-influenza_Chain
caggugcagcugguggagagcggcgccgaggugaagaaguucggcgccagcgugaaggugagcugcaaggccagcggcuacacccugaucgacuacuacaugcacugggugagaguggcccccggccagggccuggaguggaugggcuggaucaaccccaucaacggcggcaccaacuacgcccagaaguuccagggcagagugaccaugaccagagacaccagcaucaacaccgccuacauggaccugagcagccugagaagcgacgacaccgccauguacuacugcaccagaggcagacccaucggcagaaacugggagcccagagacaaggacuacuggggccagggcacccccgugaccgugagcagc

SEQ ID NO: 35574 - RNA, 372 nt, Artificial Sequence
  derived and/or modified sequence opt4 from anti-influenza_Chain
caggugcagcuggugcagagcggcgccgaggugaagaagcccggcagcagcgugaccgugagcugcaagaccagcggccacaccuucaucagcuacgccaucagcuggcugagacaggcccccggccagggccuggaguggaugggcggcaucgugcccaucuucggcaccgugaacuacacccagaaguuccagggcagacugaccaucaccgccgacgagagcaccagcaccgccuacauggaccugagcagacugaccuucgaggacaccgccaucuacuucugcgccagagaggccggcuaccacagcagcuucagcggcguguacuucgacuacuggggccagggcacccugcugaccgugagcagc

SEQ ID NO: 35575 - RNA, 372 nt, Artificial Sequence
  derived and/or modified sequence opt4 from anti-influenza_Chain
gaggugcagcugcagcagagcggccccgagcuggugaagcccggcgccagcgugaagaucagcugcaaggccagcggcuacaccuucaccgacuacaacaugcacugggugaagcagagccugggcaagagccuggaguggaucggcuacaucuaccccaacaacggcggcaccggcuacaaccagaaguucgagagcaaggccacccugaccguggacaacagcagcagcaccgccuacauggagcugagaacccugaccagcgaggacagcgccguguacuacugcgugagaagcggcgccuacuacuucaacuaccuggugcccuacuucgacuacuggggccagggcaccacccugaccgugagcagc

SEQ ID NO: 35576 - RNA, 372 nt, Artificial Sequence
  derived and/or modified sequence opt4 from anti-influenza_Chain
gaggugcagcugcagcagagcggccccgagcuggugaagcccggcgccagcgugaagaucagcugcaaggccagcggcuacaccuucaccggcuacaacaugcacugggugaagcagagccacggcaagagccuggaguggaucggcaagaucuaccccaacaacggcgugaccggcuacaaccaggaguucagaagcaaggccacccugaccguggacaacagcagcagcaccgccuacauggagcugagaagccugaccagcgaggacagcgccaucuacuucugcgugagaagcggcgccuacuacgugaacuaccuggugcccuacuucgacuacuggggccagggcaccacccugaccgugagcagc

SEQ ID NO: 35577 - RNA, 375 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcgugaccagcagcaacuaccccaucaccugggugagacaggcccccggccagggccuggaguggaugggcggcgugcugccccuguucggcgugaccaacuacgcccagaaguuccagggcagagugaccaucagcgccgacaagagcaccaacaccgccuacauggagcugagcagccugagaagcgaggacaccgccguguacuacugcgccagaggcaagagacccggcuacugcagcggcggcgugugcagcagcgacuacuggggccagggcacccuggugaccgugagcagc

SEQ ID NO: 35578 - RNA, 375 nt, Artificial Sequence
  derived and/or modified sequence opt4 from anti-influenza_Chain
caggugcagcugcaggagagcggccccggccuggugaagcccagccagacccugagccugaccugcaccgugagcggcggcagcaucagcagcggcaccuacuacuggagcuggaucagacaccaccccggcaagggccuggaguggaucggcuacaucuaccacagcggcagcgccuacuacaaccccagccuggagagcagagugaccaugagcguggacaccagcaagaaccaguucagccugaagcugagcagcgugaccgccgccgacaccgccaucuacuacugcgccagagccgagaaccugcugagccccuaccuggccgagggcuucgaccccuggggccagggcacccuggugaccgugagcagc

SEQ ID NO: 35579 - RNA, 375 nt, Artificial Sequence
  derived and/or modified sequence opt4 from anti-influenza_Chain
gaggugcagcuggugcagagcggcgccgaggugaagaagcccggcgagagccugaagaucagcugccaggccagcggcuacagcuucaccagcagauggaucggcugggugagacagaugcccggcaagggccuggagugggugggcuucaucuaccccagcgacagcgacgugagauacagccccagcuucagaggccaggugaccaucagcgccgacaagagcaucagcaccgccuaccugcaguggagcagccugaaggccagcgacaccgccauguacuucugcgccagacugggcggcaacaaggacuacggcgacuaccugugguacuucgaccuguggggcagaggcgcccuggugaccgugagcagc

SEQ ID NO: 35580 - RNA, 375 nt, Artificial Sequence
  derived and/or modified sequence opt4 from anti-influenza_Chain
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucugguacgacggcgacaacaaguacuacggcgacagcgugaagggcagauucaccaucagcagagacaacagcaagaacacccuguuccugcagaugaacagccugagagccgaggacaccgccguguacuacugcgccaaggacaccgccgaccacggcgacuacguggaccugggcuucuucgacgccuggggccagggcacccuggugaccgugagcagc

SEQ ID NO: 35581 - RNA, 375 nt, Artificial Sequence
  derived and/or modified sequence opt4 from anti-influenza_Chain
gaggugcagcuggugcagagcggcgccgagcugaagaugcccggcgagagccugaagaucagcugcaaggccagcggcuacaccuucaccaacuacuggaucggcugggugagacagacccccggcaagggccuggaguggaugggcaucaucuucccccccgacagccagaccagcuacagccccagcuuccagggccaggugaccuucagcguggacaacagcaucagcguggccuacauccaguggagcagccugaaggccagcgacaccgccaucuacuacugcgccagaagcggcaucuucgacuggagcgccccccugguggaggccuucgacaucuggggccagggcaccguggugaccgugagcagc

SEQ ID NO: 35582 - RNA, 375 nt, Artificial Sequence
  derived and/or modified sequence opt4 from anti-influenza_Chain
gaggugcagcuggugcagagcggcgccgaggugaagaagcccggcgagagccugaagaucagcugcaagggcagcggcuacagcuucagcgacuacuggaucggcugggugagacagaugcccggcgagggccuggaguggaugggcaucaucuaccccgccagcagcgagaucagauacagccccagcuuccagggccuggugaccaucagcgccgacaagagcaucaacaccgccagccugcaguggagcagccugaaggccagcgacaccgccaucuacuacugcgccagacacgccagcugcagcgccagaagcugcuacuggggccccguggacuacuggggccagggcacccuggugaccgugagcagc

SEQ ID NO: 35583 - RNA, 375 nt, Artificial Sequence
  derived and/or modified sequence opt4 from anti-influenza_Chain
caggugcagcugguggagagcggcggcggcguggugcagcccggcagaagccugagacugagcugcgccgccagcgagaucaccuucaucaccuacgccaugcacugggugagacaggcccccggcaagggccuggaguggguggcccugaucagcgacgacggcagcaacaaguucuacgccgacagcgugaagggcagauucaccaucagcagagacaacagcaagaacacccuguaccugcagaugaacagccugagagccgaggacaccgccgccuacuacugcgccagagagggcguguacuucgacagcggcaccuacagaggcuacuucgacuacuggggccaggagacccuggugaccgugagcagc

SEQ ID NO: 35584 - RNA, 375 nt, Artificial Sequence
  derived and/or modified sequence opt4 from anti-influenza_Chain
caggugcagcugcaggagagcggccccggccuggugaagcccagccagacccugagccugaccugcaccgugagcggcggcagcaucagcagcggcaacuacuacuggaacugggugagacagcaccccggcaagggccuggaguggaucggcuacaucuacuacagaggcagcaccuucuacaaccccagccugaagagcagagugaccaucagcaucgacaccagcaagaaccaguucagccugagacugagcagcgugaccgccgccgacaccgccguguacuacugcgccaaggacaccagaagcagccuggacaacuaccaguacggcauggacguguggggccagggcaccaccgugaccgugagcagc

SEQ ID NO: 35585 - RNA, 375 nt, Artificial Sequence
  derived and/or modified sequence opt4 from anti-influenza_Chain
gaggugcagcugcuggagagcggcggcggccuggugcagcccggcggcagccugagacugagcugcgccgccagcggcuucagcuucagcaccuacgccaugagcugggugagacaggcccccggcaagggccuggagugggugagcggcaucagcggcagcggcgagagcaccuacuacgccgacagcgugaagggcagauucaccgugagcagagacaacagcaagaacacccuguaccugcagaugaacagccugagagccgaggacaccgccguguacuacugcgccaagcagggcgaccacaucgccuggcugcugagaggcaucaacuucgacuacuggggccagggcgugcuggugaccgugagcagc

SEQ ID NO: 35586 - RNA, 375 nt, Artificial Sequence
  derived and/or modified sequence opt4 from anti-influenza_Chain
caggugcagcugguggagagcggcggcggcguggugcagcccggcagaagccugagacugagcugcgccgccagcggcuucgccuuccacaacagagccaugcacugggugagacaggcccccggcaagggccuggaguggguggcccugaucuacuucgacggcagcaagcaguacuacgccgacagcgugaagggcagauucaccaucagcagagacaacagcaagaacaccguguuccugcagaugaacagccugagacccgaggacaccgccguguacuacugcgccgugcccggccccaucuucggcaucuucccccccuggagcuacuucgaccacuggggccagggcauccuggugaccgugagcagc

SEQ ID NO: 35587 - RNA, 375 nt, Artificial Sequence
  derived and/or modified sequence opt4 from anti-influenza_Chain
gaggugcagcugguggagagcggcggcggcguggugcagcccggcagaagccugagacugagcugcgccgccagcggcuucgccuuccacaacagagccaugcacugggugagacaggcccccggcaagggccuggaguggguggcccugaucuacuucgacggcagcaagcaguacuacgccgacagcgugaagggcagauucaccaucagcagagacaacagcaagaacaccguguuccugcagaugaacagccugagacccgaggacaccgccguguacuacugcgccgugcccggccccaucuucggcaucuucccccccuggagcuacuucgaccacuggggccagggcauccuggugaccgugagcagc

SEQ ID NO: 35588 - RNA, 375 nt, Artificial Sequence
  derived and/or modified sequence opt4 from anti-influenza_Chain
gaggugcagcuggugcagagcggcggcggcguggugcagcccggcaagagccugagacugagcugcgccgccagcggccugaccuucagcagcuacgccgugcacugggugagacaggcccccggcaagggccuggagugggugacccugaucagcuacgacggcgccaaccaguacuacgccgacagcgugaagggcagauucaccaucagcagagacaacagcaagaacaccguguaccugcagaugaacagccugagacccgaggacaccgccguguacuacugcgccgugcccggccccguguucggcaucuucccccccuggagcuacuucgacaacuggggccagggcauccuggugaccgugagcagc

SEQ ID NO: 35589 - RNA, 375 nt, Artificial Sequence
  derived and/or modified sequence opt4 from anti-influenza_Chain
caggugcagcugguggagagcggcggcggcguggugcagcccggcaagagccugagacugagcugcgccgccagcggccugaccuucagcagcuacgccgugcacugggugagacaggcccccggcaagggccuggagugggugacccugaucagcuacgacggcgccaaccaguacuacgccgacagcgugaagggcagauucaccaucagcagagacaacagcaagaacaccguguaccugcagaugaacagccugagacccgaggacaccgccguguacuacugcgccgugcccggccccguguucggcaucuucccccccuggagcuacuucgacaacuggggccagggcauccuggugaccgugagcagc

SEQ ID NO: 35590 - RNA, 375 nt, Artificial Sequence
  derived and/or modified sequence opt4 from anti-influenza_Chain
caggugcagcugguggagagcggcggcggcguggugcagcccggcaagagccccagacugagcugcgccgccagcggccccaccuucagcagcuacgccgugcacugggugagacaggcccccggcaagggccuggagugggugacccugaucagcuacgacggcgccaaccaguacuacgccgacagcgugaagggcagauucaccaucagcagagacaacagcaagaacaccguguaccugcagaugaacagccugagacccgaggacaccgccguguacuacugcgccgugcccggccccguguucggcaucuucccccccuggagcuacuucgacaacuggggccagggcauccuggugaccgugagcagc

SEQ ID NO: 35591 - RNA, 375 nt, Artificial Sequence
  derived and/or modified sequence opt4 from anti-influenza_Chain
gaggugcagcugguggagagcggcggcggcguggugcagcccggcaagagccugagacugagcugcgccgccagcggccugaccuucagcagcuacgccgugcacugggugagacaggcccccggcaagggccuggagugggugacccugaucagcuacgacggcgccaaccaguacuacgccgacagcgugaagggcagauucaccaucagcagagacaacagcaagaacaccguguaccugcagaugaacagccugagacccgaggacaccgccguguacuacugcgccgugcccggccccguguucggcaucuucccccccuggagcuacuucgacaacuggggccagggcauccuggugaccgugagcagc

SEQ ID NO: 35592 - RNA, 375 nt, Artificial Sequence
  derived and/or modified sequence opt4 from anti-influenza_Chain
caggugcagcuggugcagagcggcgccgagcugaagagacccggcgccagcgugaaggugagcugcaagaccagcggcuacagcuucaacaacuacggcaucaacugggugagacaggcccccggccagggccuggaguggaugggcuggaucagcgccuacaccggcaacacccacuacgccaagaacuucgagggcagagugacccugaccaccgacaccagcaccagcaccgccuacauggaggugagaagccugagaagcgacgacagcgccguguacuucugcgccagagccaugauccagggcguggugacccuguaccugagacccggcgacuacuggggccagggcacccuggugaccgugagcagc

SEQ ID NO: 35593 - RNA, 375 nt, Artificial Sequence
  derived and/or modified sequence opt4 from anti-influenza_Chain
caggugcagcuggugcagagcggcgccgaggugaagcagcccggcgccagcgugaaggugagcugcaaggccagcggcuacaccuucaacgccuacuacauccacugggugagacaggcccccggccagggccuggaguggaugggcuggaucaaccccaacuucggcggcacccacuacgccagaaaguuccagggcagagugaccaugaccagagacgccagcaucaacaccgccuacauggagcuggacagacugaucagcgacgacaccgccguguacuacugcgugagauggagagccgccgccgugaucauggaccaguucuacaagauggacguguggggccagggcacccuggugaccgugagcagc

SEQ ID NO: 35594 - RNA, 375 nt, Artificial Sequence
  derived and/or modified sequence opt4 from anti-influenza_Chain
caggugcagcuggugcagagcggccccgagcugaagaagcccggcagcagcgugaagcugagcugcauggccaccggcggcaccuucaucaacuacgccuucagcugggugagacaggcccccggccagggccuggaguggcugggcggcaucauccccguguacggcaccagcaaccacguggagaagcugcagggcagagugaccaucaccgccgacgccagcaccaacaccgccuacauggagcugagcggccugagauucgacgacaccgccguguacuucugcgccgccagcaccgccaccagcggcaccuacuacgccaugagacccuucgacuucuggggccagggcacccuggugagcgugagcagc

SEQ ID NO: 35595 - RNA, 378 nt, Artificial Sequence
  derived and/or modified sequence opt4 from anti-influenza_Chain
gaggugcagcugguggagagcggcggcggcguggugcagcccggcggcagccugagacugagcugcaucgccagcgccuucaaccugggcaucuucggcaugcacugggugagacaggcccccggcaagggccuggaguggguggccuucaucagauacgacggcggcaagaccuucuacgccgacagcgugaagggcagauucaccaucagcagagacaacagcaagaacacccuguaccugcagaugaacagccugagaaccgaggacaccgcccuguacuacugcgccagagacgccaccgccgacuacuacggccccggcagcuaccccaacuggcuggaccccuggggccagggcacccuggugaccgugagc

SEQ ID NO: 35596 - RNA, 378 nt, Artificial Sequence
  derived and/or modified sequence opt4 from anti-influenza_Chain
gaggugcagcugguggagagcggccccgcccuggugaagcccacccagacccugacccugaccugcagcuucagcggcuucagccugagcaccagcggcaugagcgugagcuggaucagacagccccccggcaaggcccuggaguggcuggcccugaucgacugggacgacgacaccuacuacaucaccuacagcagcagccugaagaccagacugaccaucagcaaggacaccagcaagagccagguggugcugaccaugaccaacauggaccccguggacaccgccaccuacuacugcgccagaacccugagagugagcggcgacuacgugagagacuucgaccuguggggcagaggcacccuggugaccgugagc

SEQ ID NO: 35597 - RNA, 378 nt, Artificial Sequence
  derived and/or modified sequence opt4 from anti-influenza_Chain
caggugcagcugcaggagagcggccccggccuggugaagcccagcgagacccugagccugaccugcaccgugagcggcggcagcaucaacagcuacuacuggaacuggaucagacagccccccggcaagggccuggaguggaucggcuacaucuaccacagcggcagcaccaacuacaaccccagccugaagagcagagugaccaucagcguggacaccagcaagaaccaguucagccugcagcugagcagcgugaccgccgccgacaccgccguguacuacugcgccagacugagaaccgacuacggcgaccccgacagcguguacuacuacggcauggacguguggggccagggcaccaccgugaccgugagcagc

SEQ ID NO: 35598 - RNA, 378 nt, Artificial Sequence
  derived and/or modified sequence opt4 from anti-influenza_Chain
caggugcaccuggugcagagcggcgccgaggugagaaagcccggcgacagcgugaaggugagcugcaagaccagcggcuacaccuucagcaccuaccccguggccugggugagacaggugcccggccagggccuggaguggaugggcuggaucagcaccuacaacggcaacaccaacuucgcccagaacuuccagggcagagugacccugaccaccgacaccaccaccaacaccgccuacauggaggugagaagccugaaguucgacgacaccgccguguacuacugcgccagaguggagggcagcuacagagacuucuggaacaaccagaacagauucgaccccuggggccagggcacccuggugaccgugagcagc

SEQ ID NO: 35599 - RNA, 378 nt, Artificial Sequence
  derived and/or modified sequence opt4 from anti-influenza_Chain
gaggugcagcugguggagagcggcgccgaggugaagaagcccggcgccagcgugaaggugagcugcaaggccagcggcuacaccuucaccagcuucgacaucaacugggugagacaggcccccggccagggccuggaguggaugggcuggaugacccccaccagcggcaagaccggcuacgcccagaaguuccagggcagaaucaccaugaccagaaacaccagcaucaacaccgccuacauggagcugagcagccugagaagcgaggacaccgccguguacuucugcgccagaggccccgagagaagaaccaccaucuucgacgugauccuggacugguucgaccccuggggccagggcacccuggugaccgugagc

SEQ ID NO: 35600 - RNA, 378 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggcuucuucagcagcuacgccaucagcugggugagacaggcccccggccagggccuggaguggaugggcggcgugauccccaucuucagaaccgccaacuacgcccagaacuuccagggcagagugaccaucaccgccgacgaguucaccagcuacauggagcugagcagccugagaagcgacgacaccgccguguacuacugcgccagacugaacuaccacgacagcggcaccuacuacaacgcccccagaggcugguucgaccccuggggccagggcacccuggugaccgugagcagc

SEQ ID NO: 35601 - RNA, 378 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggcgccuucagcaacuacgccaucagcugggugagacaggcccccggccagggccuggaguggaugggcggcaucauccccaucuucggcaccaccaacuacgcccagaaguuccagggcagagugaccaucaccgccgacaaguucaccaccaucgccuacauggagcugagaagccugagaagcgaggacaccgccguguacuacugcgccagacacggcggcguguacuacuacggcagcgccagcagcggcugguucgaccccuggggccagggcacccuggugaccgugagcagc

SEQ ID NO: 35602 - RNA, 378 nt, Artificial Sequence
  derived and/or modified sequence opt4 from anti-influenza_Chain
caggugcagcugcuggagagcggcggcggcguggugagacccggcagaagccugagacuggccugcgccggcagcggcuucaccuucagcgccuacgccaugcacugggugagacaggcccccggcaagggccuggaguggguggcccacaccagcuacgacggcagagacagcuacuacguggacagcgugaagggcagauucaccaucagcagagacgacagcaagaacacccuguaccugcagaugaacagccugagacccgaggacaccgccguguacuacugcgccaaggugggccccuacaccggcuacgacgacuacaacuacuacggcauggacguguggggccacggcaccaccgugaccgugagcagc

SEQ ID NO: 35603 - RNA, 378 nt, Artificial Sequence
  derived and/or modified sequence opt4 from anti-influenza_Chain
caggugcagcugguggagagcggcggcggcguggugcagcccggcggcagccugagacugagcugcgccgccagcggcuucaacuucgacgaguacgugauguacugggugagacagagccccggcaagggccuggagugggugagccugaucggcgccgacggcagaggcaccuacaacagcgacagcgugaagggcagauucaccaucagcagagacaacagaaagaacagccuguaccugcagaugaacagccugagaagcgacgacaccgcccuguacuacugcgccaagguggagagaagcuucuacgacggcagcggcuacggcgacgcccuggagaucuggggccagggcaccauggugaccgugagcagc

SEQ ID NO: 35604 - RNA, 381 nt, Artificial Sequence
  derived and/or modified sequence opt4 from anti-influenza_Chain
gaggugcagcugcuggagagcggcggcggccuggugcaccccggcggcagccugagacugagcugcgccgccagcggcuucaccuucagcaacuacgccaugagcugggugagacaggcccccggcaagggccuggagugggugagcagcaucaacagcggcggcggcgccaccuacuacgccgacagcgugaagggcagauucaccaucagcagagacaacagcaagaacacccugagccugcagaugaacagccugagagccgaggacaccgccguguacuacugcgccaaggagggcggcaacaccaucuucggccuggugaccauggccuacuacuucgacagcuggggccagggcacccuggugaccgugagcagc

SEQ ID NO: 35605 - RNA, 381 nt, Artificial Sequence
  derived and/or modified sequence opt4 from anti-influenza_Chain
cagccccagcugcaggagagcggccccggccuggugagacccagcgagacccugagccugaccugcaccgugagcggcgacagcgugaccagaggcggcuucuacuggggcuggaucagacagccccccggcaagggccuggaguggaucggcagcaucuacuacaacuacaacaucuaccacagccccagccugaagagcagagugagccugagcguggacaccagcaagaaccaggugagccugaagcuggccagcgugaccgccgccgacaccgccguguacuacugcgccagacacuaccccuacuacgaccugcccaccggcuucuacagccaguucgacuucuggggccagggcacccccgugaccgugagcagc

SEQ ID NO: 35606 - RNA, 381 nt, Artificial Sequence
  derived and/or modified sequence opt4 from anti-influenza_Chain
ugguggcagcuggugcagagcggcgccgaggugaagaagcccggcagcagcgugaaggugagcugcaaggccagcggcggcaccuucagcagcuacgacaucagcugggugagacaggcccccggccagggccuggaguggaugggcggcaucauccccaucuacggcaccgccaacuacgcccagaaguuccagggcagagugaccaucaccgccgacgagagcaccagcaccgccuacauggagcugagcagccugagaagcgaggacaccgccguguacuacugcgccagagccggcggcgacagcagcggcuacuacggcgcccugggcagauucuuccagcacuggggccagggcacccuggugaccgugagcagc

SEQ ID NO: 35607 - RNA, 381 nt, Artificial Sequence
  derived and/or modified sequence opt4 from anti-influenza_Chain
gaggugcagcuggugcagagcggcggcgccguggugcagcccggcagaagccugagacugagcugcgccgccagcggcuucaccuucagcaucuacgccaugcacugggugagacagacccccggcaagggccuggaguggguggcccugaucagcuacgacggcaacaacaaguacuacgccgacagcgugaagggcagauucaccaucagcagagacaacuacaagaacacccuguaccugcagaugaagggccugagagccgaggacaccgcccuguacuacugcgccagaagaaucaccgagaagggcuacuacaacgacagcggcagacccaacugguucgaccccuggggccagggcacccuggugaccgugagc

SEQ ID NO: 35608 - RNA, 381 nt, Artificial Sequence
  derived and/or modified sequence opt4 from anti-influenza_Chain
caggugcagcugcagcagagcggccccagacuggugaagcccagccagacccugagccugaccugcgccaucagcggcgacagcgugagcggcgacagcggcaccuggaacuggaucagacagagccccagcagaggccuggaguggcugggcagaaccuacuacagaagcaagugguacaacgacuacgccgagagcgugaagagcagaaucgugaucaaggccgacaccagcaagaacgaguucagccugcagcugaacagcgugacccccgaggacaccgccaucuacuacugcgccagagccggcgugaagaucuucggccugaucgugggcgcccuggacaacuggggcagaggcacccuggugaccgugagcagc

SEQ ID NO: 35609 - RNA, 381 nt, Artificial Sequence
  derived and/or modified sequence opt4 from anti-influenza_Chain
caggugcagcugcagcaguggggcgccggccugcugaagcccagcgagacccugagccugaccugcaccgugagcggcggcagccugaccgacuacagcuggaacuggaucagacagccccccggcaagggccuggaguggaucggcgacacccugcacaacggcuacaccaacuacaaccccagccugagaggcagagugagcaucagcaucgacaccagcaagaaccaggugagccugagacugaccagcgugaccgccgccgacaccgcccuguacuacugcgccagaggcagcggcggcuacggcggcuucgacuacuucggcaagcugagaaccugggacuucuggggccagggcacccuggugaccgugagcagc

SEQ ID NO: 35610 - RNA, 381 nt, Artificial Sequence
  derived and/or modified sequence opt4 from anti-influenza_Chain
caggugcagcuggugcagagcggcgccgaggugagaaagcccggcgagagccugagaaucagcugcagaggcagcggcuacaacuuccccaaguacuggaucggcugggugagacagaugcccggcaagggccuggaguggaugggcaugaucuaccccggcgacagcgacgugagauacaaccccagcuuccagggccaggugaccaucagcgccgacgagagcaucaacaccgccuaccugcaguggagcagccugagaaccagcgacaccgccagauacuacugcgccagacaccugggccagcagcuggugagcaacaccuacuacuacuacggcauggacguguggggccagggcaccaccgugaccgugagcagc

SEQ ID NO: 35611 - RNA, 384 nt, Artificial Sequence
  derived and/or modified sequence opt4 from anti-influenza_Chain
cagauccagcugcaggagagcggccccggccuggugaagcccagccagacccugagccugaccugcgccaucagcggcgacagcgugagcagcaacaacgccguguggaacuggaucagacagagccccagcagaggccuggaguggcugggcagaaccuacuacagaagcaagugguacaacgacuacgccgagagcgugaagagcagaaucaccgugaaccccgacaccagcaagaaccaguucagccugcaccugaagagcgugacccccgaggacaccgccguguucuacugcgugagaagcggccacaucaccguguucggcgugaacguggacgccuucgacauguggggccagggcaccauggugaccgugagcagc

SEQ ID NO: 35612 - RNA, 384 nt, Artificial Sequence
  derived and/or modified sequence opt4 from anti-influenza_Chain
caggugcagcugcaggagagcggccccggccuggugaagcccagccagacccugagccugaccugcgccaucagcggcgacagcgugagcagcaacaacgccguguggaacuggaucagacagagccccagcagaggccuggaguggcugggcagaaccuacuacagaagcaagugguacaacgacuacgccgagagcgugaagagcagaaucaccgugaaccccgacaccagcaagaaccaguucagccugcaccugaagagcgugacccccgaggacaccgccguguucuacugcgugagaagcggccacaucaccguguucggcgugaacguggacgccuucgacauguggggccagggcaccauggugaccgugagcagc

SEQ ID NO: 35613 - RNA, 384 nt, Artificial Sequence
  derived and/or modified sequence opt4 from anti-influenza_Chain
caggugcagcugcagcagagcggccccggccuggugaagcccagccagacccugagccugaccugcgccaucagcggcgacagagugagcagcaacagcgccguguggaacuggaucagacagagccccagcagaggccuggaguggcugggcagaaccuacuacagaagcaagugguacuacgacuacgccgagagcgugaagagcagaaucgugaucgaccccgacaccagcaagaaccaggugagccugcagcugaacagcgugacccccgaggacagcgccaucuacuacugcgccagaggcggccacaucaccguguucggccugaacaucgacgccuacgacaucuggggccagggcgccaaggugaccgugagcagc

SEQ ID NO: 35614 - RNA, 384 nt, Artificial Sequence
  derived and/or modified sequence opt4 from anti-influenza_Chain
caggugcagcugcagcagagcggccccggccuggugaagcccagccagacccugagccugaccugcgccaucagcggcgacagagugagcagcaacagcgccguguggaacuggaucagacagagccccagcagaggccuggaguggcugggcagaaccuacuacagaagcaagugguacuacgacuacgccgagagcgugaagagcagaaucgugaucgaccccgacaccagcaagaaccaggugagccugcagcugaacagcgugacccccgaggacagcgccaucuacuacugcgccagaggcggccacaucaccguguucggccugaacaucgacgccuacgacaucuggggccagggcgccauggugaccgugagcagc

SEQ ID NO: 35615 - RNA, 384 nt, Artificial Sequence
  derived and/or modified sequence opt4 from anti-influenza_Chain
caggugcagcugcagcagagcggccccggccuggugaagcccagccagacccugagccugaccugcgccaucagcggcgacagagugagcagcaacagcgccguguggaacuggaucagacagagccccagcagaggccuggaguggcugggcagaaccuacuacagaagcaagugguacuacgacuacgccgagagcgugaagagcagaaucgugaucgaccccgacaccagcaagaaccaggugagccugcagcugaacagcgugacccccgaggacagcgccaucuacuacugcgccagaggcggccacaucaccgaguucggccugaacaucgacgccuacgacaucuggggccagggcgccauggugaccgugagcagc

SEQ ID NO: 35616 - RNA, 384 nt, Artificial Sequence
  derived and/or modified sequence opt4 from anti-influenza_Chain
caggugcagcugcagcagagcggccccggccuggugaagcccagccagacccugagccugaccugcgugaucagcggcgacaccgugagcagcaacagagccaccuggaacuggaugagacagagcccccugagaggccuggaguggcugggcagaaccuacuacagaagcaagugguacaacgacuacgccgugagcgugaagagcagaguggugaucaaccccgacaccagcaagaaccaggugagccugcagcugaacaccgugacccccgacgacagcggcguguacuucugcgccagaggcggccacaucaccguguucggcgugaacaucgacgccuucgacaucuggggccugggcaccaaggugaccgugagcagc

SEQ ID NO: 35617 - RNA, 384 nt, Artificial Sequence
  derived and/or modified sequence opt4 from anti-influenza_Chain
cagguggagcugcagcagagcggccccggccuggugaagcccagccagacccugagccugaccugcgccaucagcggcgacagcgugagcagcaacagcgccaccuggaacuggaucagacagagccccagcagaggccuggaguggcugggcagaaccuacuacagaagcaagugguacaacgacuacgccgacuuccugaagagaagaaucaccaucaaccccgacaccagcaacaacgaggugagccugagacugaccagcgugacccccgacgacaccgcccuguacuacugcgccagaggcggccacaucaccguguucggcgugaacaucgacgccuucgacguguggggccagggcaccauggccaccgugagcagc

SEQ ID NO: 35618 - RNA, 384 nt, Artificial Sequence
  derived and/or modified sequence opt4 from anti-influenza_Chain
caggugcagcugcagcagagcggccccggccuggugaagcccagccagacccugagccugaccugcgccaucagcggcgacagcgugagcagcaacagcgccaccuggaacuggaucagacagagccccagcagaggccuggaguggcugggcagaaccuacuacagaagcaagugguacaacgacuacgccgacuuccugaagagaagaaucaccaucaaccccgacaccagcaacaacgaggugagccugagacugaccagcgugacccccgacgacaccgcccuguacuacugcgccagaggcggccacaucaccguguucggcgugaacaucgacgccuucgacguguggggccagggcaccauggugaccgugagcagc

SEQ ID NO: 35619 - RNA, 384 nt, Artificial Sequence
  derived and/or modified sequence opt4 from anti-influenza_Chain
caggugcagcugcagcagagcggccccggccuggugaagcccagccagacccugagccugaccugcgccaucagcggcgacagcgugagcagcuacaacgccguguggaacuggaucagacagagccccagcagaggccuggaguggcugggcagaaccuacuacagaagcggcugguacaacgacuacgccgagagcgugaagagcagaaucaccaucaaccccgacaccagcaagaaccaguucagccugcagcugaacagcgugacccccgaggacaccgccguguacuacugcgccagaagcggccacaucaccguguucggcgugaacguggacgccuucgacauguggggccagggcaccauggugaccgugagcagc

SEQ ID NO: 35620 - RNA, 384 nt, Artificial Sequence
  derived and/or modified sequence opt4 from anti-influenza_Chain
caggugcagcugcagcagagcggccccggccuggugaagcccagccagacccugagccugaccugcgccaucagcggcgacagcgugagcagcaacaacgccguguggaacuggaucagacagagccccagcagaggccuggaguggcugggcagaaccuacuacagaagcaagugguacaacgacuacgccgagagcgugaagagcagaaucaccaucaaccccgacaccagcaagaaccaguucagccugcagcugaacagcgugacccccgaggacaccgccguguacuacugcgccagaagcggccacaucaccguguucggcgugaacguggacgccuucgacauguggggccagggcaccaccgugaccgugagcagc

SEQ ID NO: 35621 - RNA, 384 nt, Artificial Sequence
  derived and/or modified sequence opt4 from anti-influenza_Chain
agaggccagcuggugcagagcggcggcggcguggugcagcccggcagaagccugagacugagcugcgccgccagcggcuucguguucaacguguucggcauccacugggugagacaggcccccggcaagggccuggaguggcuggccaccaucagcuacgacggccugaacaaguacuacgccgacagcgugaagggcagaaucaccaucagcagagacaacagcaagaacacccuguaccugcagaugaacagccugagagccgaggacaccgccguguacuacugcgugagagacagcgaggagagcaccuacuacggcgacuacauguggguguacaacugguucgaccuguggggccagggcacccuggugaccgugagc

SEQ ID NO: 35622 - RNA, 384 nt, Artificial Sequence
  derived and/or modified sequence opt4 from anti-influenza_Chain
caggugcagcugcagcaguggggcagcggccugcugaagcccagcgagacccugagccugaccugcgccguguacggcggcagcuucagagacgacuacuggaccuggaucagacagccccccggcaagggccuggaguggaucggcgagaucaaccacagcggcagaaccaacuacaaccccagccugaagagcagagugaccaucagcguggacaccagccugaagcaguucagccugaaggugaucagcgugaccgccgccgacaccgccguguacuacugcgccagaggcaccagccacgugagcagauacuucgacuggcugccccccaccaacugguucgaccccuggggccagggcacccaggugaccgugagcagc

SEQ ID NO: 35623 - RNA, 384 nt, Artificial Sequence
  derived and/or modified sequence opt4 from anti-influenza_Chain
caggugcagcugcagcaguggggcgccggccugcugaagcccagcgagacccugagccugagcugcgccguguucggcggcagcuucagcgacuacuacuggaccuggaucagacagccccccggcaagggccuggaguggaucggcgagaucaagcacagcggcagaaccaacuacaaccccagccuggagagcagagugaccaucagcguggacaccagcaagaaccaguucagccugaagcugagcagcgugaccgccgccgacaccgccaucuacuacugcgccagaggcaccgaccccgacaccgagggcuacugcagaagcggcagcugcagcgccuucgacuucuggggccagggcacccuggugaccgugagcagc

SEQ ID NO: 35624 - RNA, 384 nt, Artificial Sequence
  derived and/or modified sequence opt4 from anti-influenza_Chain
caggugcagcugcagcaguggggcgccggccugcugaagcccagcgagacccugagccugaccugcggcguguacggcggcagccugagcgacuacuacuggagcuggaucagacagccccccggcaagggccuggaguggaucggcgagaucaaccacagcggcggcaccaacuacaaccccagccugaagagaagagugaccaucagcguggacaccagcaagaagcaguucagccugaagaugaacagcgugaccgccgccgacaccgccguguacuacugcgccagaggcaccgaccccgacaccgagguguacugcagagccggcaacugcgccgccuucgacuucuggggccagggcacccuggugaccgugagcagc

SEQ ID NO: 35625 - RNA, 384 nt, Artificial Sequence
  derived and/or modified sequence opt4 from anti-influenza_Chain
caggugcagcugcaggagagcggccccggccuggugaagcccagccagacccugagccugaccugcaccgugagcggcgacagcaucagcagcguggaccacuacuggagcuggaucagacagcaccccgugaagggccuggaguggaucggcuucauguacuacagcgccagcaccuacuacaaccccagccugaagagcagagugaccaucagcaccgacaccagcaagaaccaguucagccugagacugagcagcgugaccgccgccgacaccgccguguacuacugcgccagaggcaccugcgccggcgacugcagccugcacuacuacuacuacggccuggacguguggggccagggcagaaccgugaccgugagcagc

SEQ ID NO: 35626 - RNA, 384 nt, Artificial Sequence
  derived and/or modified sequence opt4 from anti-influenza_Chain
gagguggcccugguggagagcggcgccgaggugaagaagcccggcagcagcgugaaggugagcugcaaggccagcggccacaucuucagcggcuacgccaucagcugggugagacaggcccccggccagggccuggaguggaugggcggcaucauccccaucuucggcaccaccaacuacgcccagaaguuccagggcagagugaccaucaccgccgaccagagcaccagcaccgccuacauggaccugagcaaccugagaagcgaggacaccgccguguacuacugcgccagagugaaggacggcuacugcacccugaccagcugccccgugggcugguacuucgaccuguggggcagaggcacccuggugaccgugagcagc

SEQ ID NO: 35627 - RNA, 384 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggccacaucuucagcggcuacgccaucagcugggugagacaggcccccggccagggccuggaguggaugggcggcaucauccccaucuucggcaccaccaacuacgcccagaaguuccagggcagagugaccaucaccgccgaccagagcaccagcaccgccuacauggaccugagcaaccugagaagcgaggacaccgccguguacuacugcgccagagugaaggacggcuacugcacccugaccagcugccccgugggcugguacuucgaccuguggggcagaggcacccuggugaccgugagcagc

SEQ ID NO: 35628 - RNA, 384 nt, Artificial Sequence
  derived and/or modified sequence opt4 from anti-influenza_Chain
caggugcagcuggugcagagcggcgccgaggugagaaagcccggcgccagcgugaaggugagcugcaaggccagcggcuacaccuucaccagacacggcaucagcugggugagacaggcccccggccagggccuggaguggaugggcuggaucagcgccuacaccggcgacaccgacuacgcccagaaguuccagggcagagugaccaugaccaccgacaccagcaccaacaccgccuacauggagcugagaagccugagaagcgacgacgccgccguguacuacugcgccagacugagacugcagggcgaggugguggugccccccagccagagcaacugguucgaccccuggggccagggcacccuggugaccgugagcagc

SEQ ID NO: 35629 - RNA, 384 nt, Artificial Sequence
  derived and/or modified sequence opt4 from anti-influenza_Chain
caggugcagcugguggagagcggccccggccugaugaagcccagcgagacccugagccugaccugcaccgugagcggcggcagcgugagcaacuacuacuggagcuggaucagacagccccccggcaagggccuggaguggaucggcuacguguucuacagcggcagcagcaacuacaaccccagccugaacaaccccagccugaagagcagagugaccaucagcaucgacaccagcaacaaccaguucagccugaagcugagcagcgugaccgccgccgacaccgccguguacuacugcgccagaggcagagugaacagcggcuacgacuggggccccaacuucgacagcuggggccagggcgcccuggugaccgugagcagc

SEQ ID NO: 35630 - RNA, 384 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggcaccuucagcuacuacgccaucagcugggugagacaggcccccggccagggccuggaguggaugggcggcaucauccccaucgugggcaccgcccacuacacccagaaguuccagggcagagugaccaucaccgccgacgagagcaccagcaccgccuacauggagcugagcagccugagaagcgaggacaccgccguguacuucugcgccagagccgccgacgagagcguggagagccugaccaucaaggccuucagaaccaacuaccacuggggccagggcacccuggugaccgugagcagc

SEQ ID NO: 35631 - RNA, 387 nt, Artificial Sequence
  derived and/or modified sequence opt4 from anti-influenza_Chain
gaggugcagcugguggagagcggcggcggcgccgugcagcccggcgagagccugaagcugcccugcgccgccagcggcuucaccuucagcaacuacggcaugcacugggugagacaggcccccggcaagggccuggaguggguggccgugaucagcuacgacggcagcaacaaguacuacgccgacagcgugaagggcagauucaccaucagcagagacaacagcaaggacacccuguaccugcagaugaacagccugagagccgaggacaccgcccuguucuacugcgccaaggagagaccccugagacugcugagauacuucgacuggcugagcggcggcgccaacgacuacuggggccagggcacccuggugaccgugagcagc

SEQ ID NO: 35632 - RNA, 387 nt, Artificial Sequence
  derived and/or modified sequence opt4 from anti-influenza_Chain
gaggugcagcugguggagagcggcggcggcgccgugcagcccggcgagagccugaagcugagcugcgccgccagcggcuucaccuucagcaacuacggcaugcacugggugagacaggcccccggcaagggccuggaguggguggccgugaucagcuacgacggcagcaacaaguacuacgccgacagcgugaagggcagauucaccaucagcagagacaacagcaaggacacccuguaccugcagaugaacagccugagagccgaggacaccgcccuguucuacugcgccaaggagagaccccugagacugcugagauacuucgacuggcugagcggcggcgccaacgacuacuggggccagggcacccuggugaccgugagcagc

SEQ ID NO: 35633 - RNA, 387 nt, Artificial Sequence
  derived and/or modified sequence opt4 from anti-influenza_Chain
caggugcagcugguggagagcggcggcggcguggugcagcccggcagaagccugagacugagcugcgccgugagcggcuucaccuucagcagcuacgccaugcacugggugagacaggcccccggcaagggccuggaguggguggccgugaucagcuacgacggcagcaaccaguacuacgccgacagcgugaagggcagauucaccaucagcagagacaacagcaagaacacccuguaccugcagaugaacagccugagagccgaggacaccgcccuguacuacugcgccaaggaccccagacugagacaccugcuguacuuccccuucaccagcaugaucuacuucgacuacuggggccagggcacccuggugaccgugagcagc

SEQ ID NO: 35634 - RNA, 387 nt, Artificial Sequence
  derived and/or modified sequence opt4 from anti-influenza_Chain
caggugcagcuggugcagagcggcggcggcguggugcagcccggcagaagccugagacugagcugcguggccagcggcuucaccuucagcaccuacgccaugcacugggugagacaggcccccggcagaggccuggaguggguggccgugaucagcuacgacgccaacuacaaguacuacgccgacagcgugaagggcagauucagcaucagcagagacaacagccagaacacccugcaccuggagaugaacacccugagaaccgaggacaccgcccuguacuacugcgccaaggacagccagcugagaagccugcuguacuucgaguggcugagccagggcuacuucgagcccuggggccagggcacccuggugaccgugaccagc

SEQ ID NO: 35635 - RNA, 387 nt, Artificial Sequence
  derived and/or modified sequence opt4 from anti-influenza_Chain
caggugcagcuggugcagagcggcggcggcguggugcagcccggcagaagccugagacugagcugcguggccagcggcuucaccuucagcaccuacgccaugcacugggugagacaggcccccggcagaggccuggaguggguggccgugaucagcuacgacggcaacuacaaguacuacgccgacagcgugaagggcagauucagcaucagcagagacaacagcaacagcacccugcaccuggagaugaacacccugagaaccgaggacaccgcccuguacuacugcgccaaggacagccagcugagaagccugcuguacuucgaguggcugagccagggcuacuucgaccccuggggccagggcacccuggugaccgugaccagc

SEQ ID NO: 35636 - RNA, 387 nt, Artificial Sequence
  derived and/or modified sequence opt4 from anti-influenza_Chain
caggugcagcuggugcagagcggcgccgaggugaagaagcccggcagcagcgugaccgugagcugcaaggccagcggcggcaccuucagcaacuacggcaucagcugggugagacaggcccccggccagggccuggacuggaugggcggcaucaucccccuguucggcaccgccaacuacgcccagaaguuccagggcagagugaccaucaccgccgacgagagcaccagcagcagcaacauggagcugagcagccugagaagcgaggacaccgccguguacuacugcgccagagacgugcacaacuacgacuuccugaccggcuacccccugcaccuguacggcauggacguguggggccagggcaccaccgugaccgugagcagc

SEQ ID NO: 35637 - RNA, 387 nt, Artificial Sequence
  derived and/or modified sequence opt4 from anti-influenza_Chain
caggugcagcugcaggagagcggccccggccuggugaagcccagcgagacccugagccugaucugcgccgugagcggcgccagcaucagcagcagcuacuggagcuggaucagacagccccccggcaagggccuggaguggaucggcuacaucuacuacagcggcgugaccaaguacaaccccagccugaagagcagagugacccugagcguggacaccagcaagaaccacuucagccugaagcugagcuacgugaccgccgccgacaccgccguguacuacugcgccagaaaccugcccgacaucgccguggugaccgccgugcaggacgccacccccgugugguucgaccccuggggccccggcacccuggugagcgugagcagc

SEQ ID NO: 35638 - RNA, 387 nt, Artificial Sequence
  derived and/or modified sequence opt4 from anti-influenza_Chain
gaggugcagcugguggagagcggcggcggccuggugcagcccggcagaagccugagacugagcugcgccgccagcggcuucaccuucagcgacuucuggaugagcugggugagacaggcccccggcaagggccuggaguggguggccaacaucgaccaggacggcaacgagagauucuacgccgacagcgugaagggcagauucaccaucagcagagacaacgccaagaacagccuguaccugcagaugaccagccugagagccgacgacaccgccguguacuacugcgccagagacggcagagagggcuacuucuacggcagcggcagcuucuacaaccugaagggccugaacuggggccagggcacccugcugaccgugagcagc

SEQ ID NO: 35639 - RNA, 387 nt, Artificial Sequence
  derived and/or modified sequence opt4 from anti-influenza_Chain
gaggugcugaugguggagagcggcggcggccuggugcagcccggcggcagcgugagacugagcugcguggccagcggcuucagcuucagcagccacuggaugaccugggugagacaggcccccggcaagggccuggaguggguggccaacaucgaggacgacggcggcgacaaguacuacguggacagcgugaagggcagauucaucaucagcagagacaacgccaagaacagcguguaccugcagaugaacagccugagagccgaggacaccgccguguacuucugcgccagaggcagcggcagcagcgacagaagcgacuacgacccccacuacuacuacuaccuggacguguggggcaagggcgccaccgugaccgugagcagc

SEQ ID NO: 35640 - RNA, 387 nt, Artificial Sequence
  derived and/or modified sequence opt4 from anti-influenza_Chain
gaggugcagcugguggagagcggcggcgaccuggugcagcccggcagaagccugaagcugagcugcaccggcagcggcuucaccuucggcgacuacggcgugaccugggugagacaggcccccggcaagggccuggagugggugggcuucaucagaaccagacccuggggcggcaccgccgacaccgccgccagcgugaagggcagauucaccaucagcagagacgacagcaagagccuggccuaccugcagaugaacagccugaagaccgaggacaccgccguguacuacugcugcagagacgccccccccaacguggagguggccagcaugaccaacugguacuucgaccuguggggcagaggcacccuggugaccgugagcagc

SEQ ID NO: 35641 - RNA, 387 nt, Artificial Sequence
  derived and/or modified sequence opt4 from anti-influenza_Chain
gaggugcagcuggugcagagcggcagcgaggugaagaagcccggcgagagccugaagaucagcugcaagggcagcggcuacagcuucagcaacuacuggaucggcugggugagacacaugcccggcaagggccuggaguggaugggcaucaucuaccccggcgacagcgacaccagauacagccccagcuuccagggccaggugaccaugagcgccgacaagagcagcagcaccguguaccugcaguggagcagccugaaggccagcgacaccgccaucuacuacugcgccagaagaggcggccacagcuucggcuacggcagcggcggcgacacccacagcgaguucgacagcuggggccagggcacccuggugaccgugagcagc

SEQ ID NO: 35642 - RNA, 387 nt, Artificial Sequence
  derived and/or modified sequence opt4 from anti-influenza_Chain
caggugcagcugcuggagaccggcggcggccuggugaagcccggccagagccugaagcugagcugcgccgccagcggcuucaccuucaccagcuacgccaugcacugggugagacagccccccggcaagggccuggaguggguggccguggugagcuacgacggcaacuacaaguacuacgccgacagcgugcagggcagauucaccaucagcagagacaacagcaagaacacccuguaccugcagaugaacagccugagagccgaggacaccgccguguacuacugcgccaaggacagcagacugagaagccugcuguacuucgaguggcugagccagggcuacuucaaccccuggggccagggcaccacccugaccgugagcagc

SEQ ID NO: 35643 - RNA, 387 nt, Artificial Sequence
  derived and/or modified sequence opt4 from anti-influenza_Chain
caggugcagcugguggagagcggcgccgaggugaagaagcccggcgccagcgugaagcugagcugcaccgccagcggcuacaacuucgccgccuacuacauccacugggugagacaggcccccggccagggccuggaguggaugggcuggagcaaccccaacaccggcggcgccaacuacgcccaggacuuccagggcagagugaccaugaccgccgugaccagcaccagcaccgccuacauggagcugagcagacugaccagcgacgacaccgcccuguacuucugcgccagagugcccagagacagacugcugacccuguacuacgagagcagcaccuacggcuucgacuacuggggccagggcacccuggugaccgugagcagc

SEQ ID NO: 35644 - RNA, 387 nt, Artificial Sequence
  derived and/or modified sequence opt4 from anti-influenza_Chain
caggugcagcugguggagagcggcggcggccuggugcagcccggcggcagccugagacugagcugcaccgugagcggcuucaccuucaacagcuacgccaugaacugggugagacaggcccccggcaagggccuggagugggugagcggcaucagaggcagcggcgagaacaccuacuacgccgagaccgugaagggcagauucaccaucagcagagacaacagcaagaacacccuguaccuggagaugaacagccugagagccgaggacaccgccguguacuacugcgccagaaaguggggcagaaugaccguguucggcguggccaccgaccagcuguacuacuucgacuacuggggccagggcacccuggugaccgugagcagc

SEQ ID NO: 35645 - RNA, 387 nt, Artificial Sequence
  derived and/or modified sequence opt4 from anti-influenza_Chain
caggugcagcugguggagagcggccccggccuggugaagcccagccagacccugagccugaccugcaccgugagcggcggcagcaucagcaacggcggcuaccacuggagcuggaucagacagcaccccggcaagggccuggaguggaucggcaacaucuacuacagaggcagcaccuucuacgaccccagccugaagagcagagugaccaucagcguggacaccagcaagagccaguucagccugaagcugaccagcgugaccgccgccgacaccgccguguacuacugcgccagaaugccccuggccaacuacgaccugcugaccggccuguacaucggcgccuucgaccuguggggccagggcaccauggugaccgugagcagc

SEQ ID NO: 35646 - RNA, 387 nt, Artificial Sequence
  derived and/or modified sequence opt4 from anti-influenza_Chain
caggugcagcugguggagagcggcgccgaggugaagaagcccggcgccagcgugagagugagcugcaagggcagcggcuacaccuucaccgccuaccacaugcacugggugagacaggcccccggccagggcuucgagugggugggcuggaucaaccccaacagcggcgccaccuacuacaccagcaccuucgagggcagagugaccaugaccagagacaccagcaucaccaccgccuacauggagcugagcagccugagaagcgacgacaccgccguguacuacugcgccaccgacaucgugguggagagagacgccagccugggcggcuucaacagcuacggcauggacguguggggccagggcaccaccgugaccgugagcagc

SEQ ID NO: 35647 - RNA, 390 nt, Artificial Sequence
  derived and/or modified sequence opt4 from anti-influenza_Chain
caggugcagcugcagcaguggggcgccggccugcugaagcccagcgagacccugagccugaccugcgccguguacggcggcagcuucagcgugagcggcuacuacuggagcuggaucagacagccccccggcagaggccuggaguggaucggcgagaucagccacggcggcagcaccaacuacaaccccagccugaagagcagagugaccaucagcguggacaccaccaagaaccaguucagccugagacugagcagcgugaccgccgccgacaccgccguguacuacugcgccagaggcaccgaccccgacaccgagguguacugcagagugggcaacugcgccgccuucgacuacuggggccagggcagccuggugaccgugagcagc

SEQ ID NO: 35648 - RNA, 390 nt, Artificial Sequence
  derived and/or modified sequence opt4 from anti-influenza_Chain
caggugcagcugcuggagagcggccccggccuggugaagcccagccagacccugcugcugaccugcaccgugagcggcgccagcaucagcaccggcggcaacuacuggagcuggaucagacagcaccccggcaaggaccuggaguggaucggcuacaucuucuacagcggcaccaccaaguacaaccccagcguggacaaccccagccugaagagcagagugaccaugagcguggacaccagcgagaaccaguucagccugaagcugagcagcgugaccgccgccgacaccgccguguacuucugcgccagaggcagccccaacagcggcuacgacuggggcccccacuucgacuacuggggccagggcacccuggugaccgugagcagc

SEQ ID NO: 35649 - RNA, 390 nt, Artificial Sequence
  derived and/or modified sequence opt4 from anti-influenza_Chain
gaggugcagcugguggagagcggcggccaccuggugcagcccggcagaagccugagacugagcugcgccgccagcggcuucaccuucgaggacuacgccaugaacugggugagacaggcccccggcaagggccuggagugggugagcgugaucagcugggacagcggcagaaucggcuacgccgacagcgugaagggcagauucaccaucagcagagacaacgccaagaacagcagcuaccugcagaugaacagccugagacccgaggacaccgcccuguacuacugcgugagagacaugcuggccuacuacagcgacaacagcggcaagaaguacaacguguacggcauggacguguggggccagggcaccaccgugaccgugagcagc

SEQ ID NO: 35650 - RNA, 390 nt, Artificial Sequence
  derived and/or modified sequence opt4 from anti-influenza_Chain
gaggugcagcugguggagagcggcggcggccuggugcagcccggcagaagccugagacugagcugcgccgugagcggcuucaucuucgaggacuacgccaucaacugggugagacaggcccccggcaagggccuggagugggugagcaucaucagcugggacagcggcagaaucggcuacgccgacagcgugagaggcagauucaccaucagcagagacaacgccaagaacagcagcuuccugcagaugaacagccugagacccgaggacaccgccguguacuacugcgugaaggacaugcuggccuacuacuacgacggcagcggcaucagauacaaccuguacggcauggacguguggggccagggcaccaccgugaccgugagcagc

SEQ ID NO: 35651 - RNA, 390 nt, Artificial Sequence
  derived and/or modified sequence opt4 from anti-influenza_Chain
gaggugcagcugguggagagcggcggcggccuggugcagcccggcagaagccugagacugagcugcgccgugagcggcuucaucuucgaggacuacgccaucaacugggugagacaggcccccggcaagugccuggagugggugagcaucaucagcugggacagcggcagaaucggcuacgccgacagcgugagaggcagauucaccaucagcagagacaacgccaagaacagcagcuuccugcagaugaacagccugagacccgaggacaccgccguguacuacugcgugaaggacaugcuggccuacuacuacgacggcagcggcaucagauacaaccuguacggcauggacguguggggccagggcaccaccgugaccgugagcagc

SEQ ID NO: 35652 - RNA, 396 nt, Artificial Sequence
  derived and/or modified sequence opt4 from anti-influenza_Chain
cagaucacccugaaggagagcggccccacccuggugaagcccacccagacccugacccugaccugcguguucagcggcuucagccugagcaucaccggcgugagagugggcuggaucagacagccccccggcaaggcccuggaguggcuggcccugaucagcugggacgacgagaagcacuacagccccagccugcagagcagacugaccaucaccaaggacaccagcaagaaccagguggugcugaccaugaccaaccuggaccccguggacaccgccaccuacuacugcgccagaagcaccgacagaggccacgugcugagauacuucggcuggaugcugcccggcgacgccuucgacguguggggccagggcaccauggugaccgugagcagc

SEQ ID NO: 35653 - RNA, 396 nt, Artificial Sequence
  derived and/or modified sequence opt4 from anti-influenza_Chain
caggugcagcugcaggagagcggccccggccuggugaagcccagcgagacccugagccugaccugcaccgugagcagcggccccaugagcgacuacuacuggagcuggaucagacagccccccggcaagggccuggaguggaucggccacgugagcgugagccacggcggcagaaccaagagcaaccccagcgugaugagcagagugaccaucagcguggagaccagcaagaaccaguucagccugaagcugaccagcgugaccgccgccgacaccgccguguacuacugcgccagacugaacuacuacgacagaagcggcuaccacagccccgacggccccagcaacaacugguucgaccccuggggccagggcacccuggugaccgugagcagc

SEQ ID NO: 35654 - RNA, 396 nt, Artificial Sequence
  derived and/or modified sequence opt4 from anti-influenza_Chain
caggugcagcuggugcagagcggcgccgaggugaagaagcccggcgccagcgugaaggugagcugcaagaccagcggcuacaccuucaccgccuacaccauccacugggugagacaggcccccggccagagacuggaguggaugggcuggaucaacgccggcaacggccacaccaaguacagccagagauucaagggcagagugaccaucaccagagacaccagcgccagaaccaccuacauggagcugagaagccugaccagcgaggacaccgcccuguacuucugcgccagaggccccgagaccuacuacuacgacaagaccaacuggcugaacagccaccccgacgaguacuuccagcacuggggccacggcacccaggugaccgugagcagc

SEQ ID NO: 35655 - RNA, 399 nt, Artificial Sequence
  derived and/or modified sequence opt4 from anti-influenza_Chain
caggugcagcuggugcagagcggcagcgaggugaagaagcccggcgccagcgugaaggugagcugcaaggccagcggcuacaccuucaccaacuacgacaucaacuggaucagacaggcccccggccagggccuggaguggaugggcuggaucaaccccaacagcggcaccaccggcagcgcccagagauuccagggcagagugaccaucaccguggacaccagcaucaccaccguguacauggagcugagcagccugagaagcgacgacaccgccaucuacuacugcgccagaggcagagagcugcugagacugcagcacuuccugaccgacagccagagcgagagaagagacugcuucgaccccuggggccagggcacccuggugaccgugagcagc

SEQ ID NO: 35656 - RNA, 402 nt, Artificial Sequence
  derived and/or modified sequence opt4 from anti-influenza_Chain
gaggugcagcugguggagagcggcggcggccuggugaagcccggcggcagccugagacugagcugcgccgccagcggccugagcuuccugaacgccuggaugagcugggugagacaggcccccggcaagggccuggagugggugggcagaaucaagagcaacaccgacggcggcaccaccgacuacgccgcccccgugaagggcagauucaccaucagcagagacgacagcaagaacacccuguaccugcagaugagcagccugaagaccgaggacaccgccguguacuacugcaccaccgacggccccuacagcgacgacuucagaagcggcuacgccgccagauacagauacuucggcauggacguguggggccagggcaccaccgugaccgugagcagc

SEQ ID NO: 35657 - RNA, 402 nt, Artificial Sequence
  derived and/or modified sequence opt4 from anti-influenza_Chain
gaggugcagcugguggagagcggcggcggccuggugaagcccggcggcagccugagacugagcugcgccgccagcggcuucagcuuccugaacgccuggaugagcugggugagacaggcccccggcaagggccuggagugggugggcagaaucaagagcaacaccgacggcggcaccaccgacuacgccgcccccgugaagggcagauucaccaucagcagagacgacagcaagaacacccuguaccugcagaugagcagccugaagaccgaggacaccgccguguacuacugcaccaccgacggccccuacagcgacgacuucagaagcggcuacgccgccagauacagauacuucggcauggacguguggggccagggcaccaccgugaccgugagcagc

SEQ ID NO: 35658 - RNA, 402 nt, Artificial Sequence
  derived and/or modified sequence opt4 from anti-influenza_Chain
gaggugcagcugguggagagcggcggcggccuggugaagcccggcggcagccugagacugagcugcgccgccagcggccugaccuuccugaacgccuggaugagcugggugagacaggcccccggcaagggccuggagugggugggcagaaucaagagcaacaccgacggcggcaccaccgacuacgccgcccccgugaagggcagauucaccaucagcagagacgacagcaagaacacccuguaccugcagaugagcagccugaagaccgaggacaccgccguguacuacugcaccaccgacggccccuacagcgacgacuucagaagcggcuacgccgccagauacagauacuucggcauggacguguggggccagggcaccaccgugaccgugagcagc

SEQ ID NO: 35659 - RNA, 402 nt, Artificial Sequence
  derived and/or modified sequence opt4 from anti-influenza_Chain
gaggugcagcugguggagagcggcggcggccuggugaagcccggcggcagccugagacugagcugcgccgccagcggcuucagcuucagcaacgccuggaugagcugggugagacaggcccccggcaagggccuggagugggugggcagaaucaagagcaacaccgacggcggcaccaccgacuacgccgcccccgugaagggcagauucaccaucagcagagacgacagcaagaacacccuguaccugcagaugagcagccugaagaccgaggacaccgccguguacuacugcaccaccgacggccccuacagcgacgacuucagaagcggcuacgccgccagauacagauacuucggcauggacguguggggccagggcaccaccgugaccgugagcagc

SEQ ID NO: 35660 - RNA, 402 nt, Artificial Sequence
  derived and/or modified sequence opt4 from anti-influenza_Chain
gaggugcagcugguggagagcggcggcggccuggugaagcccggcggcagccugagacugagcugcgccgccagcggccugaccuucagcaacgccuggaugagcugggugagacaggcccccggcaagggccuggagugggugggcagaaucaagagcaacaccgacggcggcaccaccgacuacgccgcccccgugaagggcagauucaccaucagcagagacgacagcaagaacacccuguaccugcagaugagcagccugaagaccgaggacaccgccguguacuacugcaccaccgacggccccuacagcgacgacuucagaagcggcuacgccgccagauacagauacuucggcauggacguguggggccagggcaccaccgugaccgugagcagc

SEQ ID NO: 35661 - RNA, 402 nt, Artificial Sequence
  derived and/or modified sequence opt4 from anti-influenza_Chain
gaggugcagcugguggagagcggcggcggccuggugaagcccggcggcagccugagacugagcugcgccgccagcggcuucaccuucagcaacgccuggaugagcugggugagacaggcccccggcaagggccuggagugggugggcagaaucaagagcaacaccgacggcggcaccaccgacuacgccgcccccgugaagggcagauucaccaucagcagagacgacagcaagaacacccuguaccugcagaugagcagccugaagaccgaggacaccgccguguacuacugcaccaccgacggccccuacagcgacgacuucagaagcggcuacgccgccagauacagauacuucggcauggacguguggggccagggcaccaccgugaccgugagcagc

SEQ ID NO: 35662 - RNA, 402 nt, Artificial Sequence
  derived and/or modified sequence opt4 from anti-influenza_Chain
gaggugcagcugguggugagcggcggcggccuggugaagcccggcggcagccugagacugagcugcgccgccagcggccugagcuuccugaacgccuggaugagcugggugagacaggcccccggcaagggccuggagugggugggcagaaucaagagcaacaccgacggcggcaccaccgacuacgccgcccccgugaagggcagauucagcaucagcagagacgacagcaagaacaugcuguuccugcacaugagcagccugagaaccgaggacaccgccguguacuacugcgccaccgacggccccuacagcgacgacuucagaagcggcuacgccgccagauacagauacuucggcauggacguguggggccagggcaccaccgugaccgugagcagc

SEQ ID NO: 35663 - RNA, 402 nt, Artificial Sequence
  derived and/or modified sequence opt4 from anti-influenza_Chain
gaggugcagcugguggugagcggcggcggccuggugaagcccggcggcagccugagacugagcugcgccgccagcggccugagcuuccugaacgccuggaugagcugggugagacaggcccccggcaagugccuggagugggugggcagaaucaagagcaacaccgacggcggcaccaccgacuacgccgcccccgugaagggcagauucagcaucagcagagacgacagcaagaacaugcuguuccugcacaugagcagccugagaaccgaggacaccgccguguacuacugcgccaccgacggccccuacagcgacgacuucagaagcggcuacgccgccagauacagauacuucggcauggacguguggggccagggcaccaccgugaccgugagcagc

SEQ ID NO: 35664 - RNA, 402 nt, Artificial Sequence
  derived and/or modified sequence opt4 from anti-influenza_Chain
gaggugcagcugguggugagcggcggcggccuggugaagcccggcggcagccugagacugagcugcgccgccagcggccugagcuuccugaacgccuggaugagcugggugagacaggcccccggcaagggccuggagugggugggcagaaucaagagcaacaccgacggcggcaccaccgacuacgccgcccccgugaagggcagauucagcaucagcagagacgacagcaagaacaugcuguuccugcacaugagcagccugagaaccgaggacaccgccguguacuacugcgccaccgacggccccuacagcgacgacuucagaagcggcuacgccgccagauacagauacuucggcauggacguguggggcugcggcaccaccgugaccgugagcagc

SEQ ID NO: 35665 - RNA, 402 nt, Artificial Sequence
  derived and/or modified sequence opt4 from anti-influenza_Chain
gaggugcagcugguggagagcggcggcggccuggugaagcccggcggcagccugagacugagcugcgccgccagcggcuucaccuuccugaacgccuggaugagcugggugagacaggcccccggcaagggccuggagugggugggcagaaucaagagcaacaccgacggcggcaccaccgacuacgccgcccccgugaagggcagauucaccaucagcagagacgacagcaagaacacccuguaccugcagaugagcagccugaagaccgaggacaccgccguguacuacugcaccaccgacggccccuacagcgacgacuucagaagcggcuacgccgccagauacagauacuucggcauggacguguggggccagggcaccaccgugaccgugagcagc

SEQ ID NO: 35666 - RNA, 402 nt, Artificial Sequence
  derived and/or modified sequence opt4 from anti-influenza_Chain
gaggugcagcugguggagagcggcggcggccuggugaagcccggcggcagccugagacugagcugcgccgccagcggcuucaccuuccugaacgccuggaugagcugggugagacaggcccccggcaagugccuggagugggugggcagaaucaagagcaacaccgacggcggcaccaccgacuacgccgcccccgugaagggcagauucaccaucagcagagacgacagcaagaacacccuguaccugcagaugagcagccugaagaccgaggacaccgccguguacuacugcaccaccgacggccccuacagcgacgacuucagaagcggcuacgccgccagauacagauacuucggcauggacguguggggccagggcaccaccgugaccgugagcagc

SEQ ID NO: 35667 - RNA, 402 nt, Artificial Sequence
  derived and/or modified sequence opt4 from anti-influenza_Chain
gaggugcagcugguggagagcggcggcggccuggugaagcccggcggcagccugagacugagcugcgccgccagcggcuucaccuuccugaacgccuggaugagcugggugagacaggcccccggcaagggccuggagugggugggcagaaucaagagcaacaccgacggcggcaccaccgacuacgccgcccccgugaagggcagauucaccaucagcagagacgacagcaagaacacccuguaccugcagaugagcagccugaagaccgaggacaccgccguguacuacugcaccaccgacggccccuacagcgacgacuucagaagcggcuacgccgccagauacagauacuucggcauggacguguggggcugcggcaccaccgugaccgugagcagc

SEQ ID NO: 35668 - RNA, 414 nt, Artificial Sequence
  derived and/or modified sequence opt4 from anti-influenza_Chain
caggugcagcugcaggagagcggcggcggccuggugcagcccggcgagagccugagacugagcugcgugggcagcggcagcagcuucggcgagagcacccugagcuacuacgccgugagcugggugagacaggcccccggcaagggccuggaguggcugagcaucaucaacgccggcggcggcgacaucgacuacgccgacagcguggagggcagauucaccaucagcagagacaacagcaaggagacccuguaccugcagaugaccaaccugagaguggaggacaccggcguguacuacugcgccaagcacaugagcaugcagcagguggugagcgccggcugggagagagccgaccuggugggcgacgccuucgacguguggggccagggcaccauggugaccgugagcagc

SEQ ID NO: 35669 - RNA, 465 nt, Artificial Sequence
  derived and/or modified sequence opt4 from anti-influenza_Chain
cugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaag

SEQ ID NO: 35670 - RNA, 564 nt, Artificial Sequence
  derived and/or modified sequence opt4 from anti-influenza_Chain
aacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaag

SEQ ID NO: 35671 - RNA, 609 nt, Artificial Sequence
  derived and/or modified sequence opt4 from anti-influenza_Chain
augcugagaagccuggugcugaacgagaagcugagagccagagugcuggagagagccgaggaguuccugcugaacaacaaggccgacgaggaggugugguucagagagcuggugcugugcauccugaccagcaacagcagcuucaucagcgccuacaagagcaugaacuacauccuggacaagauccuguacauggacgagaaggagaucagcauccugcugcaggagagcggcuacagauucuacaaccugaaggccaaguaccuguacagagccaagaaccuguacggcaaggugaagaagaccaucaaggagaucgccgacaaggaccagaugcaggccagagaguucaucgccacccacaucuacggcaucggcuacaaggaggccagccacuuccugagaaacgugggcuaccuggaccuggccaucaucgacagacacauccugagauucaucaacaaccugggcauccccaucaagcugaagagcaagagagaguaccugcuggccgagagccugcugagaagcaucgccaacaaccugaacgugcaggugggccugcuggaccuguucaucuucuucaagcagaccaacaccaucgugaag

SEQ ID NO: 35672 - RNA, 615 nt, Artificial Sequence
  derived and/or modified sequence opt4 from anti-influenza_Chain
ggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgcc

SEQ ID NO: 35673 - RNA, 639 nt, Artificial Sequence
  derived and/or modified sequence opt4 from anti-influenza_Chain
gagaucgugcugacccagagccccggcacccugagccugagccccggcgagagagccacccugagcugcagagccagccagagagugagcagcuaccuggccugguaccagcagaagcccggccaggcccccagacugcugaucuacggcgccagcaccagagccgccggcauccccgacagauucagcggcagcggcagcggcaccgacuucacccugaccaucagcagacuggagcccgaggacagcgccguguacuacugccagcaguacggcagaaccccccugaccuucggcggcggcaccaagguggagaucaagagagccgccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35674 - RNA, 639 nt, Artificial Sequence
  derived and/or modified sequence opt4 from anti-influenza_Chain
gacauccagaugacccagagccccagcagccugagcgccagccugggcggcaacgugaccaucaccugcaaggccagccaggacaucaacaaguacaucgccugguaccagcacaagcccggcaagggccccagacuggugauccacuacaccagcacccugcagcccggcauccccagcagauucagcggcagcggcagcggcaccgacuacagcuucagcaucagcaaccuggagcccgaggacaucgccaccuacuacugccugcaguacgacauccuguacaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 35675 - RNA, 642 nt, Artificial Sequence
  derived and/or modified sequence opt4 from anti-influenza_Chain
gacauccagaugacccagagccccagcagccugagcgccagcgugggcgacagagugaccaucaccugcagagccagccagggcaucagcagcuaccuggccugguaccagcagaagcccggcaaggugcccacccugcugaucuacgacgccagcacccugagaagcggcgugcccagcagauucagcggcagcggcagcgccaccgacuucacccugaccaucagcagccugcagcccgaggacguggccaccuacuacugccagagauacaacagcgccccccccaucaccuucggccagggcaccagacuggagaucaagagagccgccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35676 - RNA, 642 nt, Artificial Sequence
  derived and/or modified sequence opt4 from anti-influenza_Chain
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccccagaaccuucggcggcggcaccaagguggagaucaagagagccgccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35677 - RNA, 642 nt, Artificial Sequence
  derived and/or modified sequence opt4 from anti-influenza_Chain
agcuacgugcugacccagccccccagcgugagcguggcccccggcgagaccgccaccgugaccugcggcggcaacaacaucggcagcaagagcgugcacugguaccagcagaagcccggccaggcccccgugguggugaucuacuacgacggcgacagacccagcggcauccccgagagauucagcggcagcaacagcggcgacaccgccacccugaccaucagcagaguggaggccggcgacgaggccgacuacuacugccuggugugggacuacaccagcgugcacuacguguucggcaccggcaccaaggugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacggcagccccgugaaggccggcguggagaccaccaagcccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35678 - RNA, 642 nt, Artificial Sequence
  derived and/or modified sequence opt4 from anti-influenza_Chain
gacauccagaugacccagaccagcagcagccugagcgccagccugggcgacagagugaccaucagcugcagagccagccaggacaucagaaacuaccugaacugguaccagcagaagcccgacggcaccgugaagcugcugaucuacuacaccagcagacugcacagcggcgugcccagcagauucagcgacagcggcagcggcaccgacuacagccugaccaucagcaaccuggagcaggaggaccuggccaccuacuucugccagcagaccuacacccugcccuggaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 35679 - RNA, 645 nt, Artificial Sequence
  derived and/or modified sequence opt4 from anti-influenza_Chain
gacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaag

SEQ ID NO: 35680 - RNA, 645 nt, Artificial Sequence
  derived and/or modified sequence opt4 from anti-influenza_Chain
gacauccagaugacccagagccccagcacccugagcgccagcgugggcgacagagugaccaucaccugcagagccagccagaccaucaacaacuaccuggccugguaccagcagaagcccggcaaggcccccaagcugcugaucuacaaggccagcagccuggagagcggcgugcccagcagauucagcggcagcggcagcggcaccgaguucacccugaccaucagcagccugcagcccgacgacuucgccaccuacuacugccaggaguacaacaacgacagcccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35681 - RNA, 645 nt, Artificial Sequence
  derived and/or modified sequence opt4 from anti-influenza_Chain
agcgugcugacccagccccccagcgccagcggcagcagaggccagagcaucaccaucagcugcaccggcagcaccagcgacaucggcagcuacaacuacgugagcugguaccagcagcaccccggcaccgcccccaaggugauccuguacgaggugagccagagacccagcggcgugcccgacagauucagcggcagcaagagcggcaacaccgccuuccugaccgugagcggccugcaggccgaggacgaggccgacuacuacugcgccagcuacgccggcaacaacaucuacguguucggcagcggcaccaaggugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccaccgagugcagc

SEQ ID NO: 35682 - RNA, 645 nt, Artificial Sequence
  derived and/or modified sequence opt4 from anti-influenza_Chain
agcgcccugacccagccccccagcgccagcggcagcagaggccagagcaucaccaucagcugcaccggcagcaccagcgacaucggcagcuacaacuacgugagcugguaccagcagcaccccggcaccgcccccaaggugauccuguacgaggugagccagagacccagcggcgugcccgacagauucagcggcagcaagagcggcaacaccgccuuccugaccgugagcggccugcaggccgaggacgaggccgacuacuacugcgccagcuacgccggcaacaacaucuacguguucggcagcggcaccaaggugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccaccgagugcagc

SEQ ID NO: 35683 - RNA, 648 nt, Artificial Sequence
  derived and/or modified sequence opt4 from anti-influenza_Chain
cagagcgugcugacccagccccccagcgagagcgugagccccggccagaccgccagcgugaccugcagcggccacaagcugggcgacaaguacgugagcugguaccagcagaagcccggccagagccccgugcugcugaucuaccaggacaacagaagacccagcggcauccccgagagauucaucggcagcaacagcggcaacaccgccacccugaccaucagcggcacccaggcccuggacgaggccgacuacuacugccaggccugggacagcagcaccgccguguucggcggcggcaccaagcugaccgugcugggcgccgccgccggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35684 - RNA, 648 nt, Artificial Sequence
  derived and/or modified sequence opt4 from anti-influenza_Chain
cagagcgcccugacccagcccgccagcgugagcggcagccccggccagagcaucaccaucagcugcaccggcaccagcagcgacgugggcagcuacaaccuggugagcugguaccagcagcaccccggcaaggcccccaagcugaugaucuacgaggugagcaagagacccagcggcgugagcaacagauucagcggcagcaagagcggcaacaccgccagccugaccaucagcggccugcaggccgaggacgaggccgacuacuacugccaccuguacgugggcagcagcaacuggguguucggcggcggcaccaagcuggccgugcugggccagcccaaggccgcccccagcgugacccuguucccccccagcagcaaggagcugcaggccaacaaggccacccuggugugccccaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccaccgagugcagc

SEQ ID NO: 35685 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccagagcguggacagcaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuggccccccagacugaccuucggcggcggcagcaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35686 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccagagcgugagccacaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuacccccccagacugaccuucggcggcggcagcaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35687 - RNA, 648 nt, Artificial Sequence
  derived and/or modified sequence opt4 from anti-influenza_Chain
gagaucgugaugacccagagccccgccacccugagcgugagccccggcgagagagccacccugagcugcagagccagccagagcguggacagcaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuggccccccagacugaccuucggcggcggcagcaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35688 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccagagcgugagcagcaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuggccccccagacugaccuucggcggcggcagcaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35689 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccagagcguggaccacaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuggccccccagacugaccuucggcggcggcagcaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35690 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccagagcgugagccacaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuggccccccagacugaccuucggcggcggcagcaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35691 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccagagcgugagccacaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuucccccccagacugaccuucggcggcggcagcaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35692 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccagagcguggacagcaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuucccccccagacugaccuucggcggcggcagcaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35693 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccagagcguggacagcaaccuggccugguaccagcagaagcccggccaggcccccagacugcugguguacagcgccagcaccagagccaccggcauccccgccagauucagcggcagcggcagcggcaccgaguucacccuggccaucagcagccugcagagcgaggacuucgccguguacuacugccagcacuacaccaacuacccccccagacugaccuucggcggcggcagcaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35694 - RNA, 648 nt, Artificial Sequence
  derived and/or modified sequence opt4 from anti-influenza_Chain
gagaccacccugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagagcgaggacuucgccguguacuacugccagcacuacagcaacuggccccccagacugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35695 - RNA, 648 nt, Artificial Sequence; identical to SEQ ID NO: 31576
  derived and/or modified sequence opt4 from anti-influenza_Chain

SEQ ID NO: 35696 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagcccgaggacuucgccguguacuacugccagcacuacagcaacuggccccccagacugaccuucggcggcggcaccaagguggagaucaagagaaccguggccgcccccagcgugagcaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35697 - RNA, 648 nt, Artificial Sequence
  derived and/or modified sequence opt4 from anti-influenza_Chain
gagaucgugaugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagagcgaggacuucgccguguacuacugccagcacuacagcaacuggccccccagacugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35698 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagagcgaggacuucgccguguacuacugccagcacuacagcaacuucccccccagacugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35699 - RNA, 648 nt, Artificial Sequence
  derived and/or modified sequence opt4 from anti-influenza_Chain
gagaucgugcugacccagagccccgccacccugagcgugagccccggcgagagagccacccugagcugcagagccagccaggugaucagccacaaccuggccugguaccagcagaagcccggccaggcccccagacugcugaucuacggcgccagcaccagagccagcggcauccccgccagauucagcggcagcggcagcggcaccgacuacacccugaccaucaccagccugcagagcgaggacuucgccguguacuacugccagcacuacagcaacuacccccccagacugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35700 - RNA, 648 nt, Artificial Sequence
  derived and/or modified sequence opt4 from anti-influenza_Chain
gagaucgugcugacccagagccccgccacccugagcgugagccccggcgagagagugacccugagcugcagagccagccagagcguggccaacaaccuggccugguaccagcagaagcccggccagagccccagacugcugaucuacggcgccagcaccagagacaccggcauccccgccagauucagcggcagcggcagcggcaccgaguucacccugaccaucagcagccugcagagcgaggacuucgccguguacuacugccagcaguacaacaacuggccccccauguacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35701 - RNA, 648 nt, Artificial Sequence
  derived and/or modified sequence opt4 from anti-influenza_Chain
gacaucgugaugacccagagccccagcacccugagcgccagcgugggcgacagagugaccaucaccugcagagccagccagagcaucggcaacuggcuggccugguaccagcagaagcccggcaaggcccccaagcugcugaucuacaaggugagcacccuggagagcggcgugcccagcagauucagcggcagcggcagcggcaccgaguucacccugaccaucaacagccugcagcccgacgacuucgccaccuacuacugccagagauacaccagcaacagccagggcuucaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35702 - RNA, 648 nt, Artificial Sequence
  derived and/or modified sequence opt4 from anti-influenza_Chain
gacauccagcugacccagagcccccugagcccccccgugacccugggccagcccgccagcaucagcugcagaagcagccagagccugcuguacaccgacggcuucaccuaccugagcugguaccaccagagacccggccagagccccagaagacugaucuacaagaucagcaacagagacagcggcgugcccgacagauucagcggcagcggcagcggcaccgacuucacccugaagaucagcagaguggaggccgaggacgugggcguguacuacugcaugcaggccacccacuggccccugaccuucggcgagggcaccaagguggagaucaagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccaccgagugcagc

SEQ ID NO: 35703 - RNA, 648 nt, Artificial Sequence
  derived and/or modified sequence opt4 from anti-influenza_Chain
gagaucgugcugacccagagccccggcacccugagccugagccccggcgagagagccacccugagcugcagagccagccagagcgugagaagcaacaaccuggccugguaccagcacaagcccggccaggcccccagacugcugaucuucggcgccagcagcagagccaccggcauccccgacagauucagcggcagcggcagcggcaccgacuucacccugaccaucagcagacuggagcccgaggacuucgccguguacuacugccagcaguacggcagcagccccgcccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35704 - RNA, 648 nt, Artificial Sequence
  derived and/or modified sequence opt4 from anti-influenza_Chain
cagagcgugcugacccagccccccagcgccagcggcagcagaggccagagcaucaccaucagcugcaccggcagcaccagcgacaucggcagcuacaacuacgugagcugguaccagcagcaccccggcaccgcccccaaggugauccuguacgaggugagccagagacccagcggcgugcccgacagauucagcggcagcaagagcggcaacaccgccuuccugaccgugagcggccugcagaccgacgacgaggccgacuacuacugcgccagcuacgccggcaacaacaucuacguguucggcagcggcaccaaggugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccaccgagugcagc

SEQ ID NO: 35705 - RNA, 651 nt, Artificial Sequence
  derived and/or modified sequence opt4 from anti-influenza_Chain
cagcccgugcugacccagccccccagcgccagcggcagccccggccagagagugaccaucagcugcagcggcagcagcagcaacaucggcagcuacaccgugaacugguaccagcagcugcccggcaccgcccccaagcugcugaucuacagccugaaccagagacccagcggcgugcccgacagauucagcggcagcaagagcggcaccagcgccagccuggccaucagcggccugcagagcgaggacgaggccguguacuacugcgccgccugggacgacagccugagcgcccacgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35706 - RNA, 651 nt, Artificial Sequence
  derived and/or modified sequence opt4 from anti-influenza_Chain
cagcccgugcugacccagccccccagcgccagcggcacccccggccagagagugaccaucagcugcagcggcagcagcagcaacaucggcagcaacaccgugagcugguaccagcaggugcccggcaccgcccccaagcugcugaucuacggcaacaacgagagacccagcggcgugcccgacagauucagcggcagcaagagcgccaccagcgccagccuggccaucagcggccugcagagcgaggacgaggccgacuacuacugcgccgccugggacgacagccugaacggcuucuggguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccaccgagugcagc

SEQ ID NO: 35707 - RNA, 651 nt, Artificial Sequence
  derived and/or modified sequence opt4 from anti-influenza_Chain
agcuacgugcugacccagccccccagcgugagcggcacccccggccagagagugaucaucagcugcagcggcuacagcagcaacaucggcagcaacaccgugaacugguaccagcaguuccccggcaccgcccccagacugcugaucuacgccaacaaccagagaccccccggcgugcccgacagauucagcggcagcaagagcggcaccagcgccagccuggccaucagcggccugcagagcgacgacgagagcgacuacuacugcgccgccugggacgacagccugaacggccacuggguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35708 - RNA, 654 nt, Artificial Sequence
  derived and/or modified sequence opt4 from anti-influenza_Chain
agcuacgugcugacccagccccccagcgugagcguggcccccggccagaccgccagaaucaccugcggcggcaacaacaucggcagcaagagcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacgccguguucggcggcggcacccagcugaccgugcugggcgccgccgccggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35709 - RNA, 654 nt, Artificial Sequence
  derived and/or modified sequence opt4 from anti-influenza_Chain
cagagcguggugacccagccccccagcgugagcguggcccccggccagaccgccagaaucaccugcggcggcaacaacaucggcagcaagagcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacuacguguucggcaccggcaccaaggugaccgugcugggcgccgccgccggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35710 - RNA, 654 nt, Artificial Sequence
  derived and/or modified sequence opt4 from anti-influenza_Chain
cugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcgacagcgccaucgugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccug

SEQ ID NO: 35711 - RNA, 657 nt, Artificial Sequence
  derived and/or modified sequence opt4 from anti-influenza_Chain
agcagcgagcugacccagccccccagcgccagcggcacccccggccagagagugaccaucagcugcagcggcagcaccagcaacaucggcuacaaccccgugagcugguaccagcaggugcccggcaccgcccccaagcugcugaucuacagcaacaccgagagacccagcggcgugcccgacagauucagcggcagcaagagcggcaccagcgccagccuggccaucagcggccugcagagcgaggacgaggccgacuacuacugcgccgccugggacgacacccugaacggccccguguucggcggcggcaccaaggugaccgugcugggccagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35712 - RNA, 657 nt, Artificial Sequence; identical to SEQ ID NO: 31592
  derived and/or modified sequence opt4 from anti-influenza_Chain

SEQ ID NO: 35713 - RNA, 660 nt, Artificial Sequence
  derived and/or modified sequence opt4 from anti-influenza_Chain
agcuacgugcugacccagccccccagcgccagcggcacccccggccagagagugaccaucagcugcagcggcagcaccuucaacaucggcagcaacgccguggacugguacagacagcugcccggcaccgcccccaagcugcugaucuacagcaacaaccagagacccagcggcgugcccgacagauucagcggcagcagaagcggcaccagcgccagccuggccaucagcggccugcagagcgaggacgaggccgacuacuacugcgccgccugggacgacauccugaacgugcccguguucggcggcggcaccaagcugaccgugcugggcgccgccgccggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35714 - RNA, 660 nt, Artificial Sequence
  derived and/or modified sequence opt4 from anti-influenza_Chain
cagagcgcccugacccagcccgccgccgugagcggcagccccggccagagcaucaccaucagcugcaccggcaccagcagcgacgugggcggcuacaacuacgugagcugguaccagcagcaccccggcaaggcccccaagcugaugaucuacgaggugagcaacagacccagcggcgugagcaacagauucagcggcagcaagagcggcaacaccgccagccugaccaucagcggccugcaggccgaggacgaggccgacuacuacugcagcagcuacaccagcagcagcaccuacguguucggcaccggcaccaaggugaccgugcugggcgccgccgccggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35715 - RNA, 660 nt, Artificial Sequence
  derived and/or modified sequence opt4 from anti-influenza_Chain
agcuacgugcugacccagccccccagcgugagcggcacccccggccagagagugaccaucagcugcagcggcagcagaagcaacgugggcgacaacagcguguacugguaccagcacgugcccgagauggcccccaagcugcugguguacaagaacacccagagacccagcggcgugcccgccagauucagcggcagcaagagcggcaccagcgccagccuggccaucaucggccugcagagcggcgacgaggccgacuacuacugcguggccugggacgacagcguggacggcuacguguucggcagcggcaccaaggugaccgugcugggcgccgccgccggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35716 - RNA, 660 nt, Artificial Sequence
  derived and/or modified sequence opt4 from anti-influenza_Chain
agcuacgugcugacccagccccccagcgccagcggcacccccggccagagagugaccaucagcugcagcggcagcagcagcaacaucggcagcaacuacguguacugguaccagcagcugcccggcaccgcccccaagcugcugaucuacagagacggccagagacccagcggcgugcccgacagauucagcggcagcaagagcggcaccagcgccagccuggccaucagcggccugagaagcgacgacgaggccgacuacuacugcgccaccugggacgacaaccugagcggccccguguucggcggcggcaccaagcugaccgugcugggcgccgccgccggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35717 - RNA, 660 nt, Artificial Sequence
  derived and/or modified sequence opt4 from anti-influenza_Chain
cagagcgcccugacccagcccgccagcgugagcggcagccccggccagagcaucaccaucagcugcaccggcaccagcagcgacgugggcggcuacaacuacgugagcugguaccagcagcaccccggcaaggcccccaagcugaugaucuacgaggugagcaacagacccagcggcgugagcaacagauucagcggcagcaagagcggcaacaccgccagccugaccaucagcggccugcaggccgaggacgaggccgacuacuacugcagcagcuacaccagcagcagcacccugguguucggcaccggcaccaaggugaccgugcugggcgccgccgccggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35718 - RNA, 660 nt, Artificial Sequence
  derived and/or modified sequence opt4 from anti-influenza_Chain
accgugcugacccagccccccagcgugagcggcgcccccggccagagagugaccaucagcugcaccggcagcagcagcaacaucggcgccggcuacgacgugcacugguaccagcagcugcccggcaccgcccccaagcugcugaucuacggcaacagcaacagacccagcggcgugcccgacagauucagcggcagcaagagcggcaccagcgccacccugggcaucaccggccugcagaccggcgacgaggccgacuacuacugcggcaccugggacagcagccugagcgccuacguguucggcaccggcaccaaggugaccgugcugggcgccgccgccggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35719 - RNA, 663 nt, Artificial Sequence
  derived and/or modified sequence opt4 from anti-influenza_Chain
cagagcgugcugacccagccccccagcgugagcgccgcccccggccagaaggugaccaucagcugcagcggcagcagcagcaacaucggcaacgacuacgugagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccaacuacuacugcgccaccugggacagaagacccaccgccuacgugguguucggcggcggcaccaagcugaccgugcugggcgccgccgccggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35720 - RNA, 675 nt, Artificial Sequence
  derived and/or modified sequence opt4 from anti-influenza_Chain
auggugggcuucacccccguggcccuggccgcccuggccgccaccggcgcccuggccuuccccgccggcaacgccaccgagcuggagaagagacagaccacccccaacagcgagggcuggcacgacggcuacuacuacagcugguggagcgacggcggcgcccaggccaccuacaccaaccuggagggcggcaccuacgagaucagcuggggcgacggcggcaaccuggugggcggcaagggcuggaaccccggccugaacgccagagccauccacuucgagggcguguaccagcccaacggcaacagcuaccuggccguguacggcuggaccagaaacccccugguggaguacuacaucguggagaacuucggcaccuacgaccccagcagcggcgccaccgaccugggcaccguggagugcgacggcagcaucuacagacugggcaagaccaccagagugaacgcccccagcaucgacggcacccagaccuucgaccaguacuggagcgugagacaggacaagagaaccagcggcaccgugcagaccggcugccacuucgacgccugggccagagccggccugaacgugaacggcgaccacuacuaccagaucguggccaccgagggcuacuucagcagcggcuacgccagaaucaccguggccgacgugggc

SEQ ID NO: 35721 - RNA, 687 nt, Artificial Sequence
  derived and/or modified sequence opt4 from anti-influenza_Chain
agaagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35722 - RNA, 696 nt, Artificial Sequence
  derived and/or modified sequence opt4 from anti-influenza_Chain
cacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaag

SEQ ID NO: 35723 - RNA, 699 nt, Artificial Sequence
  derived and/or modified sequence opt4 from anti-influenza_Chain
augagacccagcauccaguuccugggccugcugcuguucuggcugcacggcggccagugcgacauccagaugacccagagccccagcagccugagcgccagccugggcggcaacgugaccaucaccugcaaggccagccaggacaucaacaaguacaucgccugguaccagcacaagcccggcaagggccccagacuggugauccacuacaccagcacccugcagcccggcauccccagcagauucagcggcagcggcagcggcaccgacuacagcuucagcaucagcaaccuggagcccgaggacaucgccaccuacuacugccugcaguacgacauccuguacaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 35724 - RNA, 702 nt, Artificial Sequence
  derived and/or modified sequence opt4 from anti-influenza_Chain
augaugagcagcgcccaguuccugggccugcugcugcugugcuuccagggcaccagaugcgacauccagaugacccagaccagcagcagccugagcgccagccugggcgacagagugaccaucagcugcagagccagccaggacaucagaaacuaccugaacugguaccagcagaagcccgacggcaccgugaagcugcugaucuacuacaccagcagacugcacagcggcgugcccagcagauucagcgacagcggcagcggcaccgacuacagccugaccaucagcaaccuggagcaggaggaccuggccaccuacuucugccagcagaccuacacccugcccuggaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 35725 - RNA, 702 nt, Artificial Sequence
  derived and/or modified sequence opt4 from anti-influenza_Chain
auggaggcccccgcccagcugcuguuccugcugcugcuguggcugcccgacaccaccggcgagaucgugcugacccagagccccgccacccugagccugagccccggcgagagagccacccugagcugcagagccagcgagaacaucuggaacaaccuggccugguaccagcagaagcccggccaggcccccagacugcugaucagcggcgccagcaccggcgccaccggcgugcccagcagauucagaggcagcggcagcagaaccgaguucacccugaccaucagcagccugcagagcgaggacuucgccaucuacuucugccagcaguacaacagcuggcccagaaccuucggccccggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35726 - RNA, 705 nt, Artificial Sequence
  derived and/or modified sequence opt4 from anti-influenza_Chain
auggagacccccgcccagcugcuguuccugcugcugcuguggcugcccgacaccaccggcgagaucgugcugacccagagccccggcacccugagccugagccccggcgagagagccacccugagcugcagagccagccagagccugagcagcagcagccuggugugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcaacagccccuacaccuucggccagggcacccagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35727 - RNA, 705 nt, Artificial Sequence
  derived and/or modified sequence opt4 from anti-influenza_Chain
auggagacccccgcccagcugcuguuccugcugcugcuguggcugcccgacaccaccggcgagaccgugcugacccagagccccggcacccugagccugagccccggcgagagagccacccugagcugcagagccagccagagcgugagcaucagcuaccuggccugguaccagagaaagcccggccaggcccccagacugcugaucuacggcgccagcagaagagccaccggcauccccgacagauucagcggcagcggcagcggcaccgacuucacccugaccaucagcagacuggagcccgaggacuucgccguguacuacugccagcaguacggcagcagccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 35728 - RNA, 705 nt, Artificial Sequence
  derived and/or modified sequence opt4 from anti-influenza_Chain
auggccuggaugaugcugcugcugacccugcugauccacugcaccggcagcugggcccagagcgugcugacccagccccccagcgugagcgccgcccccggccagaaggugaccaucagcugcagcggcagcagcagcaacaucggcaagaacuacgugagcugguaccagcagcugcccggcaccgcccccaagcugcugaucuacgacaacgacaagagacccagcggcauccccgacagauucagcggcagcaagagcggcaccagcgccacccugggcaucaccggccugcagaccggcgacgaggccgacuaccacugcggcgccugggacagcagccugaacggcggcguguucggcggcggcaccaaggugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 35729 - RNA, 714 nt, Artificial Sequence
  derived and/or modified sequence opt4 from anti-influenza_Chain
augaugaagaagaagagcugguucacccugaugaucaccggcgugaucagccuguucuucagcgugagcgccuucgccggcaacguguucugggagccccugagcuacuucaacagcagcaccuggcagaaggccgacggcuacagcaacggccagauguucaacugcaccuggagagccaacaacgugaacuucaccaacgacggcaagcugaagcugagccugaccagccccgccaacaacaaguucgacugcggcgaguacagaagcaccaacaacuacggcuacggccuguacgaggugagcaugaagcccgccaagaacaccggcaucgugagcagcuucuucaccuacaccggccccagccacggcacccagugggacgagaucgacaucgaguuccugggcaaggacaccaccaaggugcaguucaacuacuacaccaacggcgugggcggccacgagaagaucaucaaccugggcuucgacgccagcaccagcuuccacaccuacgccuucgacuggcagcccggcuacaucaagugguacguggacggcgugcugaagcacaccgccaccaccaacauccccagcacccccggcaagaucaugaugaaccuguggaacggcaccggcguggacagcuggcugggcagcuacaacggcgccaacccccuguacgccgaguacgacugggugaaguacaccagcaac

SEQ ID NO: 35730 - RNA, 729 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggcaccuucagcagcuacgccaucagcugggugagacaggcccccggccagggccuggaguggaugggcggcaucaugggcauguucggcaccaccaacuacgcccagaaguuccagggcagagugaccaucaccgccgacgaguucaccagcgccgccuacauggagcugagaagccugagaagcgaggacaccgccguguacuacugcgccagaagcagcggcuacuaccccgaguacuuccaggacuggggccagggcacccuggugaccgugagcagcggcaccggcggcagcggcggcaccggcagcggcaccggcggcagcacccagagcgugcugacccagccccccagcgagagcgugagccccggccagaccgccagcgugaccugcagcggccacaagcugggcgacaaguacgugagcugguaccagcagaagcccggccagagccccgugcugcugaucuaccaggacaacagaagacccagcggcauccccgagagauucaucggcagcaacagcggcaacaccgccacccugaccaucagcggcacccaggcccuggacgaggccgacuacuacugccaggccugggacagcagcaccgccguguucggcggcggcaccaagcugaccgugcugggc

SEQ ID NO: 35731 - RNA, 729 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggccccuucagaaacuucgccaucaacugggugagacaggcccccggccagggccuggaguggaugggcggcaucaucgccguguucggcaccaccaaguacgcccacaaguuccagggcagagugaccaucaccgccgacgacagcaccaacaccgccuacauggagcugggcagccugaagagcgaggacaccgccguguacuacugcgccagaggcccccacuacuacagcagcuacauggacguguggggcgagggcaccaccgugaccgugagcagcggcaccggcggcagcggcggcaccggcagcggcaccggcggcagcaccgacauccagcugacccagagccccagcagccugagcgccagcgugggcgacagagugaccaucaccugcagagccagccagggcaucagcaccuaccuggccugguaccagcagaagcccggcaaggugcccaagcugcugaucuacgccgccagcacccugcagagcggcgugcccagcagauucagcggcagcggcagcggcaccgacuucacccugaccaucagcagccugcagcccgaggacguggccaccuacuacugccagaaguacaacagcgcccccagcuucggccccggcaccaagguggacaucaagaga

SEQ ID NO: 35732 - RNA, 729 nt, Artificial Sequence
  derived and/or modified sequence opt4 from anti-influenza_Chain
augagcuacagagugaagagaaugcugaugcugcuggugaccggccuguuccugagccugagcaccuucgccgccagcgccagcgcccagaccggcggcagcuucuacgagcccuucaacaacuacaacaccggccuguggcagaaggccgacggcuacagcaacggcaacauguucaacugcaccuggagagccaacaacgugagcaugaccagccugggcgagaugagacugagccugaccagccccagcuacaacaaguucgacugcggcgagaacagaagcgugcagaccuacggcuacggccuguacgaggugaacaugaagcccgccaagaacgugggcaucgugagcagcuucuucaccuacaccggccccaccgacggcacccccugggacgagaucgacaucgaguuccugggcaaggacaccaccaaggugcaguucaacuacuacaccaacggcgugggcaaccacgagaagaucgugaaccugggcuucgacgccgccaacagcuaccacaccuacgccuucgacuggcagcccaacagcaucaagugguacguggacggccagcugaagcacaccgccaccacccagaucccccagacccccggcaagaucaugaugaaccuguggaacggcgccggcguggacgaguggcugggcagcuacaacggcgugaccccccugagcagaagccugcacugggugagauacaccaagaga

SEQ ID NO: 35733 - RNA, 735 nt, Artificial Sequence
  derived and/or modified sequence opt4 from anti-influenza_Chain
caggugcagcugcagcagagcggcgccgaggugaagaagcccggcagcagcgugaaggugagcugcaaggugagcggcgugaucuucagcggcagcgccaucagcugggugagacaggcccccggccagggccuggaguggaugggcggcaucagcccccuguucggcaccaccaacuacgcccagaaguuccagggcagagugaccaucaccgccgaccagagcaccaacaccaccuacauggaggugaacagccugagauacgaggacaccgccguguacuucugcgccagaggccccaaguacuacagcgaguacauggacguguggggcaagggcaccaccgugaccgugagcagcggcaccggcggcagcggcggcaccggcagcggcaccggcggcagcaccgacauccagaugacccagagccccagcagccugagcgccagcgugggcgacagagugaccaucaccugcagagccagccagggcaucagcagcuaccuggccugguaccagcagaagcccggcaaggugcccacccugcugaucuacgacgccagcacccugagaagcggcgugcccagcagauucagcggcagcggcagcgccaccgacuucacccugaccaucagcagccugcagcccgaggacguggccaccuacuacugccagagauacaacagcgccccccccaucaccuucggccagggcaccagacuggagaucaagaga

SEQ ID NO: 35734 - RNA, 735 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaccuucagcagcuacggcaucagcugggugagacaggcccccggccagggccuggaguggaugggcgacaucaucggcauguucggcagcaccaacuacgcccagaacuuccagggcagacugaccaucaccgccgacgagagcaccagcaccgccuacauggagcugagcagccugagaagcgaggacaccgccguguacuacugcgccagaagcagcggcuacuaccccgccuaccugccccacuggggccagggcacccuggugaccgugagcagcggcaccggcggcagcggcggcaccggcagcggcaccggcggcagcaccgagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccccagaaccuucggcggcggcaccaagguggagaucaagaga

SEQ ID NO: 35735 - RNA, 735 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaccuucagcagcuacgccaucagcugggugagacaggcccccggccagggccuggaguggaugggcggcaucaucggcauguucggcaccgccaacuacgcccagaaguuccagggcagagugaccaucaccgccgacgaguucaccagcaccgccuacauggagcugagcagccugagaagcgaggacaccgccguguacuacugcgccagaggcaacuacuacuacgagagcagccuggacuacuggggccagggcacccuggugaccgugagcagcggcaccggcggcagcggcggcaccggcagcggcaccggcggcagcacccagagcguggugacccagccccccagcgugagcguggcccccggccagaccgccagaaucaccugcggcggcaacaacaucggcagcaagagcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacuacguguucggcaccggcaccaaggugaccgugcugggc

SEQ ID NO: 35736 - RNA, 735 nt, Artificial Sequence
  derived and/or modified sequence opt4 from anti-influenza_Chain
gaggugcagcuggugcagagcggcgccgaggugaagaagcccggcgccagcgugaaggugagcugcaaggccagcggcuacaccuucaccggcuacuacguguacugggugagacaggcccccggccagggccuggaguggaugggcuggaucagcgccuacaacggcaacaccaacuacgcccagaaguuccagggcagagugaccaucaccgccgacaagagcaccagcaccgccuacauggagcugagcagccugagaagcgaggacaccgccguguacuacugcgccagaagcagaagccuggacguguggggccagggcaccaccgugaccgugagcagcggcaccggcggcagcggcggcaccggcagcggcaccggcggcagcaccgacguggugaugacccagagccccgacagccuggccgugagccugggcgagagagccaccaucaacugcaagagcagccagagcgugcuguacagcagcaacaacaagaacuaccuggccugguaccagcagaagcccggccagccccccaagcugcugaucuacugggccagcaccagagagagcggcgugcccgacagauucagcggcagcggcagcggcaccgacuucacccugaccaucagcagccugcaggccgaggacguggccguguacuacugccagcaguacuacagcaccccccugaccuucggcggcggcaccaagguggacaucaagaga

SEQ ID NO: 35737 - RNA, 735 nt, Artificial Sequence
  derived and/or modified sequence opt4 from anti-influenza_Chain
gaggugcagcugguggagaccggcgccgaggugaagaagcccggcagcagcgugaaggugcccugcaagagcagcggcagccccuucagaagcaacgccgugagcugggugagacaggcccccggccagggccuggagugggugggcggcauccugggcguguucggcagccccagcuacgcccagaaguuccagggcagagugaccaucaccgccgacgagagcaccaacaccgugcacauggagcugagaggccugagaagcgaggacaccgccguguacuacugcgccagaggccccaccuacuacuacagcuacauggacguguggggcaagggcaccaccgugaccgugagcagcggcaccggcggcagcggcggcaccggcagcggcaccggcggcagcaccagcuacgugcugacccagccccccagcgagagcguggcccccggccagaccgccagaaucaccugcggcggcaacaacaucggcagaaacagcgugcacugguaccagcagaagcccggccaggcccccgugcuggugguguacgacgacagcgacagacccagcggcauccccgagagauucagcggcagcaagagcggcaacaccgccacccugaucaucagcagaguggaggugggcgacgaggccgacuacuacugccagguguggcacagcagcagcgaccacuacguguucggcaccggcaccaaggugaccgugcugggc

SEQ ID NO: 35738 - RNA, 735 nt, Artificial Sequence
  derived and/or modified sequence opt4 from anti-influenza_Chain
cagaugcagcuggugcagagcggcgccgaggugaagaagcccggcagcagcgugaaggugagcugcaaggccagcggcggcaccuucagcagcuacgccaucagcugggugagacaggcccccggccagggccuggaguggaugggcggcaucuucggcauguucggcaccgccaacuacgcccagaaguuccagggcagagugaccaucaccgccgacgaguucaccagcgccgccuacauggagcugagcagccugggcagcgaggacaccgccauguacuacugcgccagaagcagcggcuacuacccccaguacuuccaggacuggggccagggcacccuggugaccgugagcagcggcaccggcggcagcggcggcaccggcagcggcaccggcggcagcaccgagaucgugaugacccagagccccggcacccugagccugagccccggccagagagccacccugagcugcagagccagccagagcgugagcagcagcuaccuggccugguaccagcagaagcccggccaggcccccagacugcugauguacggcgccagcagcagagccaccggcauccccgacagauucagcggcagcggcagcggcaccgacuucacccugaccaucagcagacuggagcccgaggacuucgccguguacuacugccagcaguacggcagcagcagccugaccuucggcggcggcaccaagcuggagaucaagaga

SEQ ID NO: 35739 - RNA, 735 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcgugaccuucagcuacuacgccaugagcugggugagacaggcccccggccagggccuggaguggaugggcggcaucagccccauguucggcaccaccaccuacgcccagaaguuccagggcagagugaccaucaccgccgacgacagcaccagcaccgccuacauggaggugagaagccugagaagcgaggacaccgccguguacuacugcgccagaagcagcaacuacuacgacagcguguacgacuacuggggccagggcacccuggugaccgugagcagcggcaccggcggcagcggcggcaccggcagcggcaccggcggcagcacccagagcguggugacccagccccccagcgagagcguggcccccggccagaccgccagaaucaccugcggcggccacaacaucggcagcaacagcgugcacugguaccagcagaagcccggccaggcccccgugcuggugguguacgacaacagcgacagacccagcggcauccccgagagauucagcggcagcaacagcggcaacaccgccacccugaccaucagcagaguggaggccggcgacgaggccgacuacuacugccagguguggggcagcagcagcgaccacuacguguucggcaccggcaccaaggugaccgugcugggc

SEQ ID NO: 35740 - RNA, 738 nt, Artificial Sequence
  derived and/or modified sequence opt4 from anti-influenza_Chain
caggugcagcuggugcagagcggcggcggccuggugaagcccggcggcagccugagacugagcugcgccgccagcggcuucaccuucagcagcuacagcaugaacugggugagacaggcccccggcaagggccuggagugggugagcagcaucagcagcagcagcagcuacaucuacuacguggacagcgugaagggcagauucaccaucagcagagacaacgccaagaacagccuguaccugcagaugaacagccugagagccgaggacaccgccguguacuacugcgccagaggcggcggcagcuacggcgccuacgagggcuucgacuacuggggccagggcacccuggugaccgugagcagcggcaccggcggcagcggcggcaccggcagcggcaccggcggcagcaccgagaucgugcugacccagagccccggcacccugagccugagccccggcgagagagccacccugagcugcagagccagccagagagugagcagcuaccuggccugguaccagcagaagcccggccaggcccccagacugcugaucuacggcgccagcaccagagccgccggcauccccgacagauucagcggcagcggcagcggcaccgacuucacccugaccaucagcagacuggagcccgaggacagcgccguguacuacugccagcaguacggcagaaccccccugaccuucggcggcggcaccaagguggagaucaagaga

SEQ ID NO: 35741 - RNA, 738 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagcggcaccggcggcagcggcggcaccggcagcggcaccggcggcagcaccagcuacgugcugacccagccccccagcgugagcguggcccccggccagaccgccagaaucaccugcggcggcaacaacaucggcagcaagagcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacgccguguucggcggcggcacccagcugaccgugcugggc

SEQ ID NO: 35742 - RNA, 738 nt, Artificial Sequence
  derived and/or modified sequence opt4 from anti-influenza_Chain
gaggugcagcugguggagaccggcgccgaggugaagaagcccggcgccagcgugaaggugagcugcaaggccagcggcuacaccuucaccagcuacuacaugcacugggugagacaggcccccggccagggccuggaguggaugggcuggaucaaccccaacagcggcggcaccaacuacgcccagaaguuccagggcagagugaccaugaccagagacaccagcaucagcaccgccuacauggagcugagcagacugagaagcgacgacaccgccguguacuacugcgccagagagggcaaguggggcccccaggccgccuucgacaucuggggccagggcaccauggugaccgugagcagcggcaccggcggcagcggcggcaccggcagcggcaccggcggcagcaccgagaucgugaugacccagagccccggcacccugagccugagccccggcgagagagccacccugagcugcagagccagccagagcgugagcagcagcuaccuggccugguaccagcagaagcccggccaggcccccagacugcugaucuacgacgccagcagcagagccaccgacauccccgacagauucagcggcagcggcagcggcaccgacuucacccugaccaucagcagacuggagcccgaggacuucgccguguacuacugccagcaguacggcagcagccuguggaccuucggccagggcaccaagguggagaucaagaga

SEQ ID NO: 35743 - RNA, 738 nt, Artificial Sequence
  derived and/or modified sequence opt4 from anti-influenza_Chain
gaggugcagcugguggagagcggcggcggccuggugcagcccggcggcagccugagacugagcugcgccgccagcggcuucaccuucagcaucuacgccaugagcugggugagacaggcccccggcaagggccuggagugggugagcgccaucagcagcagcggcgacagcaccuacuacgccgacagcgugaagggcagauucaccaucagcagagacaacgccagaaacacccuguaccugcagaugaacagccugagagccgaggacaccgccguguacuacugcgccagagccuacggcuacaccuucgaccccuggggccagggcacccuggugaccgugagcagcggcaccggcggcagcggcggcaccggcagcggcaccggcggcagcaccgagaucgugcugacccagagcccccugagccugcccgugacccccggcgagcccgccagcaucagcugcagaagcagccagagccugcugcacagcaacggcuacaacuaccuggacugguaccugcagaagcccggccagagcccccagcugcugaucuaccugggcagcaacagagccagcggcgugcccgacagauucagcggcagcggcagcggcaccgacuucacccugaagaucagcagaguggaggccgaggacgugggcguguacuacugcaugcaggcccugcagaccccccugaccuucggcggcggcaccaagguggagaucaagaga

SEQ ID NO: 35744 - RNA, 738 nt, Artificial Sequence
  derived and/or modified sequence opt4 from anti-influenza_Chain
gaggugcagcugguggagaccggcgccgaggugaagaagcccggcagcagcgugaaggugagcugcaaggccagcggcggcaccuucagaacccacgccaucagcugggugagacaggcccccggccagggccuggaguggaugggcggcaucaucgccaucuucggcaccgccaacuacgcccagaaguuccagggcagaaucaccaucaccgccgacgagagcaccagcaccgccuacauggagcugagcagccugagaagcgaggacaccgccguguacuucugcgccagaggcagcggcuaccacaucagcacccccuucgacaacuggggccagggcacccuggugaccgugagcagcggcaccggcggcagcggcggcaccggcagcggcaccggcggcagcaccagcuacgugcugacccagccccccagcgugagcguggcccccggccagaccgccagaaucaccugcggcggcaacaacaucggcagcaagggcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacgugguguucggcggcggcaccaagcugaccgugcugggc

SEQ ID NO: 35745 - RNA, 738 nt, Artificial Sequence
  derived and/or modified sequence opt4 from anti-influenza_Chain
gaggugcagcuggugcagagcggcgccgaggugaagaagcccggcagcagcgugaaggugagcugcaaggccagcggcggcaucuucagaagcaacagcaucagcugggugagacaggcccccggccagggccuggaguggaugggcggcaucuucgcccuguucggcaccaccgacuacgcccagaaguuccagggcagagugaccaucaccgccgacgagagcagcaccaccguguaccuggagcugagcagccugaccagcgaggacaccgccguguacuacugcgccagaggcagcggcuacaccaccagaaacuacuucgacuacuggggccagggcacccuggugaccgugagcagcggcaccggcggcagcggcggcaccggcagcggcaccggcggcagcaccgagaucgugcugacccagagccccggcacccugagccugagccccggcgagagagccacccugagcugcagagccagccagagcgugagcagcaacuaccugggcugguaccagcagaagcccggccaggcccccagacugcugaucuacggcgccagcagcagagccagcggcauccccgacagauucagcggcggcggcagcggcaccgacuucacccugaccaucagcagacuggagcccgaggacuucgccguguacuacugccagcaguacggcagcagcccccugaccuucggcggcggcaccaagguggagaucaagaga

SEQ ID NO: 35746 - RNA, 738 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaucuucaacagcuacgccaucagcugggugagacaggcccccggccagggccuggaguggaugggcggcaucaucgccaucuuccacacccccaaguacgcccagaaguuccagggcagagugaccaucaccgccgacgagagcaccaacaccgccuacauggagcugagaagccugaagagcgaggacaccgcccuguacuacugcgccagaggcagcaccuacgacuucagcagcggccuggacuacuggggccagggcacccuggugaccgugagcagcggcaccggcggcagcggcggcaccggcagcggcaccggcggcagcacccaggccggccugacccagccccccagcgugagcguggcccccggccagaccgccagaaucaccugcggcggcaacaacaucggcagcaagagcgugcacugguaccagcagaagcccggccaggcccccgugcuggugguguacgacgacagcgacagacccagcggcauccccgagagauucagcggcagcaacagcggcaacaccgccacccugaccaucagcagaguggaggccggcgacgaggccgacuacuacugccaggugugggacagcagcagcgaccacgugguguucggcggcggcaccaagcugaccgugcugggc

SEQ ID NO: 35747 - RNA, 741 nt, Artificial Sequence
  derived and/or modified sequence opt4 from anti-influenza_Chain
cagaugcagcuggugcagagcggcgccgaggugaagaagcccggcagcagcgugaaggugagcugcaaggccagcggcggcaccuucagcagcuacgccaucaccugggugagacaggcccccggccagggccuggaguggaugggcggcaucaucggcauguucggcagcaccaacuacgcccagaacuuccagggcagagugaccaucaccgccgacgagagcaccagcaccgccuacauggagcugagcagccugagaagcgaggacaccgccguguacuacugcgccagaagcaccggcuacuaccccgccuaccugcaccacuggggccagggcacccuggugaccgugagcagcggcaccggcggcagcggcggcaccggcagcggcaccggcggcagcacccagagcgcccugacccagcccagaagcgugagcggcagccccggccagagcgugaccaucagcugcaccggcaccagcagcgacgugggcggcuacaacuacgugagcugguaccagcagcaccccggcaaggcccccaagcugaugaucuacgacgugagcaagagacccagcggcgugcccgacagauucagcggcagcaagagcggcaacaccgccagccugaccaucagcggccugcaggccgaggacgaggccgacuacuacugcagcagcuacaccagcagcagcacccacguguucggcaccggcaccaaggugaccgugcugggc

SEQ ID NO: 35748 - RNA, 744 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagcggcaccggcggcagcggcggcaccggcagcggcaccggcggcagcaccagcuacgugcugacccagccccccagcgccagcggcacccccggccagagagugaccaucagcugcagcggcagcaccuucaacaucggcagcaacgccguggacugguacagacagcugcccggcaccgcccccaagcugcugaucuacagcaacaaccagagacccagcggcgugcccgacagauucagcggcagcagaagcggcaccagcgccagccuggccaucagcggccugcagagcgaggacgaggccgacuacuacugcgccgccugggacgacauccugaacgugcccguguucggcggcggcaccaagcugaccgugcugggc

SEQ ID NO: 35749 - RNA, 744 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagcggcaccggcggcagcggcggcaccggcagcggcaccggcggcagcacccagagcgcccugacccagcccgccgccgugagcggcagccccggccagagcaucaccaucagcugcaccggcaccagcagcgacgugggcggcuacaacuacgugagcugguaccagcagcaccccggcaaggcccccaagcugaugaucuacgaggugagcaacagacccagcggcgugagcaacagauucagcggcagcaagagcggcaacaccgccagccugaccaucagcggccugcaggccgaggacgaggccgacuacuacugcagcagcuacaccagcagcagcaccuacguguucggcaccggcaccaaggugaccgugcugggc

SEQ ID NO: 35750 - RNA, 744 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagcggcaccggcggcagcggcggcaccggcagcggcaccggcggcagcaccagcuacgugcugacccagccccccagcgugagcggcacccccggccagagagugaccaucagcugcagcggcagcagaagcaacgugggcgacaacagcguguacugguaccagcacgugcccgagauggcccccaagcugcugguguacaagaacacccagagacccagcggcgugcccgccagauucagcggcagcaagagcggcaccagcgccagccuggccaucaucggccugcagagcggcgacgaggccgacuacuacugcguggccugggacgacagcguggacggcuacguguucggcagcggcaccaaggugaccgugcugggc

SEQ ID NO: 35751 - RNA, 744 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagcggcaccggcggcagcggcggcaccggcagcggcaccggcggcagcaccagcuacgugcugacccagccccccagcgccagcggcacccccggccagagagugaccaucagcugcagcggcagcagcagcaacaucggcagcaacuacguguacugguaccagcagcugcccggcaccgcccccaagcugcugaucuacagagacggccagagacccagcggcgugcccgacagauucagcggcagcaagagcggcaccagcgccagccuggccaucagcggccugagaagcgacgacgaggccgacuacuacugcgccaccugggacgacaaccugagcggccccguguucggcggcggcaccaagcugaccgugcugggc

SEQ ID NO: 35752 - RNA, 744 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaccuucagcuucuacagcaugagcugggugagacaggcccccggccagggccuggaguggaugggcggcaucauccccauguucggcaccaccaacuacgcccagaaguuccagggcagagugaccaucaccgccguggagagcaccagcaccgccuacauggaggugagcagccugagaagcgaggacaccgccguguacuacugcgccagaggcgacaagggcaucuacuacuacuacauggacguguggggcaagggcaccaccgugaccgugagcagcggcaccggcggcagcggcggcaccggcagcggcaccggcggcagcacccagagcgcccugacccagcccgccagcgugagcggcagccccggccagagcaucaccaucagcugcaccggcaccagcagcgacgugggcggcuacaacuacgugagcugguaccagcagcaccccggcaaggcccccaagcugaugaucuacgaggugagcaacagacccagcggcgugagcaacagauucagcggcagcaagagcggcaacaccgccagccugaccaucagcggccugcaggccgaggacgaggccgacuacuacugcagcagcuacaccagcagcagcacccugguguucggcaccggcaccaaggugaccgugcugggc

SEQ ID NO: 35753 - RNA, 744 nt, Artificial Sequence
  derived and/or modified sequence opt4 from anti-influenza_Chain
augagccuguucggcgacaccaucgccuaccugcugagccugaucgaggacggcgagggcaaggccgagcuggccgagaagcugcacugcugguucggcggcaaggaguucgaccuggacagcgcccuggaguggaucaagaacaagagaugccugaccgacauccagaaggcccugaucggcgccagcaucugcuuccugaagcccaaggaccaggagagaaagagaagauucaucaccgagccccugagcggcaugggcaccaccgccaccaagaagaagggccugauccuggccgagagaaagaugagaagaugcgugagcuuccacgaggccuucgagaucgccgagggccacgagagcagcgcccugcuguacugccugauggugauguaccugaaccccgagaacuacagcaugcaggugaagcugggcacccugugcgcccugugcgagaagcaggccagccacagccacagagcccacagcagagccgccagaagcagcgugcccggcgugagaagagagaugcagauggugagcgccaugaacaccgccaagaccaugaacggcaugggcaagggcgaggacgugcagaagcuggccgaggagcugcagaacaacaucggcgugcugagaagccugggcgccagccagaagaacggcgagggcaucgccaaggacgugauggaggugcugaagcagagcagcaugggcaacagcgcccuggugagaaaguaccug

SEQ ID NO: 35754 - RNA, 747 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagcggcaccggcggcagcggcggcaccggcagcggcaccggcggcagcacccagagcgugcugacccagccccccagcgugagcgccgcccccggccagaaggugaccaucagcugcagcggcagcagcagcaacaucggcaacgacuacgugagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccaacuacuacugcgccaccugggacagaagacccaccgccuacgugguguucggcggcggcaccaagcugaccgugcugggc

SEQ ID NO: 35755 - RNA, 750 nt, Artificial Sequence
  derived and/or modified sequence opt4 from anti-influenza_Chain
caggugcagcuggugcagagcggcgccgaggugaagaagcccggcagcagcgugagagugagcugcaaggccagcggcagcaucuucagaaacuacgccaugagcugggugagacaggcccccggccagggccuggaguggaugggcggcaucaucgccaucuucggcacccccaaguacgcccagaaguuccagggcagagugaccaucaccgccgacgagagcaccagcaccguguacauggagcugagcggccugagaagcgaggacaccgccauguacuacugcgccagaaucccccacuacaacuucggcagcggcagcuacuucgacuacuggggccagggcacccuggugaccgugagcagcggcaccggcggcagcggcggcaccggcagcggcaccggcggcagcaccaccgugcugacccagccccccagcgugagcggcgcccccggccagagagugaccaucagcugcaccggcagcagcagcaacaucggcgccggcuacgacgugcacugguaccagcagcugcccggcaccgcccccaagcugcugaucuacggcaacagcaacagacccagcggcgugcccgacagauucagcggcagcaagagcggcaccagcgccacccugggcaucaccggccugcagaccggcgacgaggccgacuacuacugcggcaccugggacagcagccugagcgccuacguguucggcaccggcaccaaggugaccgugcugggc

SEQ ID NO: 35756 - RNA, 756 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggccacaucuucagcggcuacgccaucagcugggugagacaggcccccggccagggccuggaguggaugggcggcaucauccccaucuucggcaccaccaacuacgcccagaaguuccagggcagagugaccaucaccgccgaccagagcaccagcaccgccuacauggaccugagcaaccugagaagcgaggacaccgccguguacuacugcgccagagugaaggacggcuacugcacccugaccagcugccccgugggcugguacuucgaccuguggggcagaggcacccuggugaccgugagcagcggcaccggcggcagcggcggcaccggcagcggcaccggcggcagcaccgagaucgugaugacccagagccccggcacccugagccugagccccggcgagagagccacccugagcugcagagccagccagagcgugagcagcagcuaccuggccugguaccagcagaagcccggccaggcccccagacugcugaucuucggcgccagcagcagagccaccggcauccccgacagauucagcggcagcggcagcggcaccgacuucacccugaccaucagcagacuggagcccgaggacuucgccguguacuacugccagcaguacggcagcagccugaccuucggcggcggcaccaagcuggagaucaagaga

SEQ ID NO: 35757 - RNA, 768 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggcuucuucagcagcuacgccaucagcugggugagacaggcccccggccagggccuggaguggaugggcggcgugauccccaucuucagaaccgccaacuacgcccagaacuuccagggcagagugaccaucaccgccgacgaguucaccagcuacauggagcugagcagccugagaagcgacgacaccgccguguacuacugcgccagacugaacuaccacgacagcggcaccuacuacaacgcccccagaggcugguucgaccccuggggccagggcacccuggugaccgugagcagcggcaccggcggcagcggcggcaccggcagcggcaccggcggcagcaccgacauccagaugacccagagccccgacagccuggccgugagccugggcgagaaggccaccaucaacugcaagagcagccagagcauccugaacagcagcaacaacaagaacuaccuggccugguaccagcagaagcccggccagccccccaagcugcugaucuacugggccagcaccagagagagcggcgugcccgacagauucagcggcagcggcagcggcaccgacuucacccugaccaucagcagccugcaggccgaggacguggccguguacuacugccagcaguacuacagcagcccccccaccuucggccagggcaccaagguggagaucaagaga

SEQ ID NO: 35758 - RNA, 768 nt, Artificial Sequence; identical to SEQ ID NO: 35757
  derived and/or modified sequence opt4 from anti-influenza_Chain

SEQ ID NO: 35759 - RNA, 771 nt, Artificial Sequence
  derived and/or modified sequence opt4 from anti-influenza_Chain
aucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaag

SEQ ID NO: 35760 - RNA, 771 nt, Artificial Sequence; identical to SEQ ID NO: 35759
  derived and/or modified sequence opt4 from anti-influenza_Chain

SEQ ID NO: 35761 - RNA, 777 nt, Artificial Sequence
  derived and/or modified sequence opt4 from anti-influenza_Chain
auggugaagagcaaguaccugguguucaucagcguguucagccugcuguucggcguguucguggugggcuucagccaccagggcgugaaggccgaggaggagagacccaugggcaccgccuucuacgagagcuucgacgccuucgacgacgagagauggagcaaggccggcguguggaccaacggccagauguucaacgccaccugguaccccgagcaggugaccgccgacggccugaugagacugaccaucgccaagaagaccaccagcgccagaaacuacaaggccggcgagcugagaaccaacgacuucuaccacuacggccuguucgaggugagcaugaagcccgccaagguggagggcaccgugagcagcuucuucaccuacaccggcgagugggacugggacggcgaccccugggacgagaucgacaucgaguuccugggcaaggacaccaccagaauccaguucaacuacuucaccaacggcgugggcggcaacgaguucuacuacgaccugggcuucgacgccagcgagagcuucaacaccuacgccuucgaguggagagaggacagcaucaccugguacgugaacggcgaggccgugcacaccgccaccgagaacaucccccagaccccccagaagaucaugaugaaccuguggcccggcgugggcguggacggcuggaccggcguguucgacggcgacaacacccccguguacagcuacuacgacugggugagauacaccccccugcagaacuaccagauccaccag

SEQ ID NO: 35762 - RNA, 777 nt, Artificial Sequence; identical to SEQ ID NO: 35761
  derived and/or modified sequence opt4 from anti-influenza_Chain

SEQ ID NO: 35763 - RNA, 783 nt, Artificial Sequence
  derived and/or modified sequence opt4 from anti-influenza_Chain
gacauccagaugacccagagccccagcagcgugagcgccagcgugggcgacagagugaccaucaccugcagagccagccaggacaucagcaccuggcuggccugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuucugccagcaggccaacagcuucccccccaccuucggcugcggcaccaagcuggagaucaagggcggcggcggcagcggcggcggcggcagcggcggcggcggcagcggcggcggcggcagcgaggugcagcugguggugagcggcggcggccuggugaagcccggcggcagccugagacugagcugcgccgccagcggccugagcuuccugaacgccuggaugagcugggugagacaggcccccggcaagugccuggagugggugggcagaaucaagagcaacaccgacggcggcaccaccgacuacgccgcccccgugaagggcagauucagcaucagcagagacgacagcaagaacaugcuguuccugcacaugagcagccugagaaccgaggacaccgccguguacuacugcgccaccgacggccccuacagcgacgacuucagaagcggcuacgccgccagauacagauacuucggcauggacguguggggccagggcaccaccgugaccgugagcagc

SEQ ID NO: 35764 - RNA, 783 nt, Artificial Sequence; identical to SEQ ID NO: 35763
  derived and/or modified sequence opt4 from anti-influenza_Chain

SEQ ID NO: 35765 - RNA, 789 nt, Artificial Sequence
  derived and/or modified sequence opt4 from anti-influenza_Chain
augggcuucgugcuguucagccagcugcccagcuuccugcuggugagcacccugcugcuguuccuggugaucagccacagcugcagagcccagaacggcggcagcuaccccuacaagagcggcgaguacagaaccaagagcuucuucggcuacggcuacuacgaggugagaaugaaggccgccaagaacgugggcaucgugagcagcuucuucaccuacaccggccccagcgacaacaaccccugggacgagaucgacaucgaguuccugggcaaggacaccaccaaggugcaguucaacugguacaagaacggcgugggcggcaacgaguaccugcacaaccugggcuucgacgccagccaggacuuccacaccuacggcuucgaguggagacccgacuacaucgacuucuacguggacggcaagaagguguacagaggcaccagaaacauccccgugacccccggcaagaucaugaugaaccuguggcccggcaucggcguggacgaguggcugggcagauacgacggcagaaccccccugcaggccgaguacgaguacgugaaguacuaccccaacggcagaagcaagcugguggugaacacccccuucguggccguguucagcaacuucgacagcagccagugggagaaggccgacugggccaacggcagcguguucaacugcguguggaagcccagccaggugaccuucagcaacggcaagaugauccugacccuggacagagaguacguggaccaccaccaccaccaccacaaggacgagcug

SEQ ID NO: 35766 - RNA, 789 nt, Artificial Sequence; identical to SEQ ID NO: 35765
  derived and/or modified sequence opt4 from anti-influenza_Chain

SEQ ID NO: 35767 - RNA, 840 nt, Artificial Sequence
  derived and/or modified sequence opt4 from anti-influenza_Chain
auggcccaggugggcagaggcgccagcccccugagcagagccagagugcccccccugccccacccccuggacggcgagcaccugccccacgaccccgccggcggcggccacggcaaggccagcagccaggacgcccccgugggccagcugcccggccaccuggccagacccgccuucuuccacuaccugaagaacagcuuccuggugugcagccugaccaccguguucgcccuggccguggccaccuucgccggcuacgcccuggccagauucagauuccccggcgccgagcuguucggcggcagcgugcuggugacccaggugauccccggcauccuguuccugauccccaucuacaucauguacaucuacgugcagaacugggugagaagcgcccugggccuggaggugagacuggugggcagcuacggcggccugguguucaccuacaccgccuucuucgugccccugagcaucuggauccugagaggcuucuucgccagcauccccaaggagcuggaggaggccgccaugguggacggcgccacccccuuccaggccuuccacagagugauccugccccuggcccugcccggccuggccgccaccgccguguacaucuuccugaccgccugggacgagcugcuguucgcccaggugcugaccaccgaggccaccgccaccgugcccgugggcaucagaaacuucgugggcaacuaccagaacagauacgaccuggugauggccgccgccaccguggccacccugcccgugcuggugcuguucuucuucgugcagagacagcugauccagggccugaccgccggcgccgugaagggc

SEQ ID NO: 35768 - RNA, 840 nt, Artificial Sequence; identical to SEQ ID NO: 35767
  derived and/or modified sequence opt4 from anti-influenza_Chain

SEQ ID NO: 35769 - RNA, 843 nt, Artificial Sequence
  derived and/or modified sequence opt4 from anti-influenza_Chain
auggccgacaacaugaccaccacccagaucgaggugggccccggcgccaccaacgccaccaucaacuucgaggccggcauccuggagugcuacgagagauucagcuggcagagagcccuggacuaccccggccaggacagacugcacagacugaagagaaagcuggagagcagaaucaagacccacaacaagagcgagcccgagaacaagagaaugagccuggaggagagaaaggccaucggcgugaagaugaugaaggugcugcuguucauggaccccagcgccggcaucgagggcuucgagcccuacugcgugaagaaccccagcaccagcaagugccccaacuacgacuggaccgacuacccccccacccccggcaaguaccuggacgacaucgaggaggagcccgagaacguggaccaccccaucgagguggugcugagagacaugaacaacaaggacgccagacagaagaucaaggacgaggugaacacccagaaggagggcaaguucagacugaccaucaagagagacaucagaaacgugcugagccugagagugcuggugaacggcaccuuccugaagcaccccaacggcgacaagagccugagcacccugcacagacugaacgccuacgaccagaacggcggccugguggccaagcugguggccaccgacgacagaaccguggaggacgagaaggacggccacagaauccugaacagccuguucgagagauucgacgagggccacagcaagcccaucagagccgccgagaccgccgugggcgugcugagccaguucggccaggagcacagacugagccccgaggagggcgacaac

SEQ ID NO: 35770 - RNA, 843 nt, Artificial Sequence; identical to SEQ ID NO: 35769
  derived and/or modified sequence opt4 from anti-influenza_Chain

SEQ ID NO: 35771 - RNA, 858 nt, Artificial Sequence
  derived and/or modified sequence opt4 from anti-influenza_Chain
augugcaccaugccccugaugaagcugaagaagaugaugagaagaaccgccuuccugcugagcgugcugaucggcugcagcaugcugggcagcgacagaagcgacaaggccccccacugggagcugguguggagcgacgaguucgacuacagcggccugcccgaccccgagaagugggacuacgacgugggcggccacggcuggggcaaccaggagcugcaguacuacaccagagccagaaucgagaacgccagagugggcggcggcgugcugaucaucgaggccagacacgagcccuacgagggcagagaguacaccagcgccagacuggugaccagaggcaaggccagcuggaccuacggcagauucgagaucagagccagacugcccagcggcagaggcaccuggcccgccaucuggaugcugcccgacagacagaccuacggcagcgccuacuggcccgacaacggcgagaucgacaucauggagcacgugggcuucaaccccgacguggugcacggcaccgugcacaccaaggccuacaaccaccugcugggcacccagagaggcggcagcaucagagugcccaccgccagaaccgacuuccacguguacgccaucgaguggacccccgaggagaucagaugguucguggacgacagccuguacuacagauuccccaacgagagacugaccgaccccgaggccgacuggagacacuggcccuucgaccagcccuuccaccugaucaugaacaucgccgugggcggcgccuggggcggccagcagggcguggaccccgaggccuuccccgcccagcuggugguggacuacgugagaguguacagauggguggag

SEQ ID NO: 35772 - RNA, 858 nt, Artificial Sequence; identical to SEQ ID NO: 35771
  derived and/or modified sequence opt4 from anti-influenza_Chain

SEQ ID NO: 35773 - RNA, 900 nt, Artificial Sequence
  derived and/or modified sequence opt4 from anti-influenza_Chain
aacgugcccgaguggagcuacaucguggagaaggccaaccccgccaacgaccugugcuaccccggcaacuucaacgacuacgaggagcugaagcaccugcugagcagaaucaaccacuucgagaagauccagggcuacauccccgaggcccccagagacggccaggccuacgugagaaaggacggcgagugggugcugcugagcaccuuccugagaagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35774 - RNA, 900 nt, Artificial Sequence; identical to SEQ ID NO: 35773
  derived and/or modified sequence opt4 from anti-influenza_Chain

SEQ ID NO: 35775 - RNA, 927 nt, Artificial Sequence
  derived and/or modified sequence opt4 from anti-influenza_Chain
auggugaacagaagagaccugaucaaguggagcgccguggcccugggcgccggcgccggccuggccggccccgcccccgccgcccacgccgccgaccuggagugggagcaguaccccgugcccgccgcccccggcggcaacagaagcuggcagcugcugcccagccacagcgacgacuucaacuacaccggcaagccccagaccuucagaggcagauggcuggaccagcacaaggacggcuggagcggccccgccaacagccuguacagcgccagacacagcuggguggccgacggcaaccugaucguggagggcagaagagcccccgacggcagaguguacugcggcuacgugaccagcagaacccccguggaguacccccuguacaccgaggugcugaugagagugagcggccugaagcugagcagcaacuucuggcugcugagcagagacgacgugaacgagaucgacgugaucgagugcuacggcaacgagagccugcacggcaagcacaugaacaccgccuaccacaucuuccagagaaaccccuucaccgagcuggccagaagccagaagggcuacuucgccgacggcagcuacggcuacaacggcgagaccggccagguguucggcgacggcgccggccagccccugcugagaaacggcuuccacagauacggcgugcacuggaucagcgccaccgaguucgacuucuacuucaacggcagacuggugagaagacugaacagaagcaacgaccugagagaccccagaagcagauucuucgaccagcccaugcaccugauccugaacaccgagagccaccaguggagaguggacagaggcaucgagcccaccgacgccgagcuggccgaccccagcaucaacaacaucuacuacagaugggugagaaccuaccaggccgug

SEQ ID NO: 35776 - RNA, 927 nt, Artificial Sequence; identical to SEQ ID NO: 35775
  derived and/or modified sequence opt4 from anti-influenza_Chain

SEQ ID NO: 35777 - RNA, 960 nt, Artificial Sequence
  derived and/or modified sequence opt4 from anti-influenza_Chain
aucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcgacagcgccaucgugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccug

SEQ ID NO: 35778 - RNA, 960 nt, Artificial Sequence; identical to SEQ ID NO: 35777
  derived and/or modified sequence opt4 from anti-influenza_Chain

SEQ ID NO: 35779 - RNA, 960 nt, Artificial Sequence; identical to SEQ ID NO: 35777
  derived and/or modified sequence opt4 from anti-influenza_Chain

SEQ ID NO: 35780 - RNA, 978 nt, Artificial Sequence
  derived and/or modified sequence opt4 from anti-influenza_Chain
acccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcaga

SEQ ID NO: 35781 - RNA, 978 nt, Artificial Sequence; identical to SEQ ID NO: 35780
  derived and/or modified sequence opt4 from anti-influenza_Chain

SEQ ID NO: 35782 - RNA, 960 nt, Artificial Sequence; identical to SEQ ID NO: 35777
  derived and/or modified sequence opt4 from anti-influenza_Chain

SEQ ID NO: 35783 - RNA, 990 nt, Artificial Sequence
  derived and/or modified sequence opt4 from anti-influenza_Chain
augugcagcagcauccccagccugagagagguguucgccaacgacuucagaaucggcgccgccgugaaccccgugacccuggaggcccagcagagccugcugaucagacacgugaacagccugaccgccgagaaccacaugaaguucgagcaccugcagcccgaggagggcagauucaccuucgacaucgccaucaagagcagcaccagccccuucagcagccacggcgugagaggccacacccugguguggcacaaccagacccccagcuggguguuccaggacagccagggccacuucgugggcagagacgugcugcuggagagaaugaagagccacaucagcaccguggugcagagauacaagggcaagguguacugcugggacgugaucaacgaggccguggccgacgagggcagcgaguggcugagaagcagcaccuggagacagaucaucggcgacgacuucauccagcaggccuuccuguacgcccacgaggccgaccccgaggcccugcuguucuacaacgacuacaacgagugcuuccccgagaagagagagaagaucuacacccuggugaagagccugagagacaagggcauccccauccacggcaucggcaugcaggcccacuggagccugaacagacccacccuggacgagaucagagccgccaucgagagauacgccagccugggcgugauccugcacaucaccgagcuggacaucagcauguucgaguucgacgaccacagaaaggaccuggccgcccccaccaacgagaugguggagagacaggccgagagauacgagcagaucuucagccuguucaaggaguacagagacgugauccagaacgugaccuucuggggcaucgccgacgaccacaccuggcuggaccacuuccccgugcagggcagaaagaacuggccccugcuguucgacgagcagcacaaccccaagcccgccuucuggagaguggugaacauc

SEQ ID NO: 35784 - RNA, 990 nt, Artificial Sequence; identical to SEQ ID NO: 35783
  derived and/or modified sequence opt4 from anti-influenza_Chain

SEQ ID NO: 35785 - RNA, 1002 nt, Artificial Sequence
  derived and/or modified sequence opt4 from anti-influenza_Chain
augaagaacagagugaucagccugcugauggccagccugcugcuggugcugagcgugaucguggcccccuucuacaaggccgaggccgccaccguggugaacacccccuucguggccguguucagcaacuucgacagcagccagugggagaaggccgacugggccaacggcagcguguucaacugcguguggaagcccagccaggugaccuucagcaacggcaagaugauccugacccuggacagagaguacggcggcagcuaccccuacaagagcggcgaguacagaaccaagagcuucuucggcuacggcuacuacgaggugagaaugaaggccgccaagaacgugggcaucgugagcagcuucuucaccuacaccggccccagcgacaacaaccccugggacgagaucgacaucgaguuccugggcaaggacaccaccaaggugcaguucaacugguacaagaacggcgugggcggcaacgaguaccugcacaaccugggcuucgacgccagccaggacuuccacaccuacggcuucgaguggagacccgacuacaucgacuucuacguggacggcaagaagguguacagaggcaccagaaacauccccgugacccccggcaagaucaugaugaaccuguggcccggcaucggcguggacgaguggcugggcagauacgacggcagaaccccccugcaggccgaguacgaguacgugaaguacuaccccaacggcgugccccaggacaaccccacccccacccccaccaucgcccccagcacccccaccaaccccaaccugccccugaagggcgacgugaacggcgacggccacgugaacagcagcgacuacagccuguucaagagauaccugcugagagugaucgacagauuccccgugggcgaccagagcguggccgacgugaacagagacggcagaaucgacagcaccgaccugaccaugcugaagagauaccugaucagagccauccccagccug

SEQ ID NO: 35786 - RNA, 1002 nt, Artificial Sequence; identical to SEQ ID NO: 35785
  derived and/or modified sequence opt4 from anti-influenza_Chain

SEQ ID NO: 35787 - RNA, 1041 nt, Artificial Sequence
  derived and/or modified sequence opt4 from anti-influenza_Chain
aucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcgacagcgccaucgugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugggcuacauccccgaggcccccagagacggccaggccuacgugagaaaggacggcgagugggugcugcugagcaccuuccug

SEQ ID NO: 35788 - RNA, 1041 nt, Artificial Sequence; identical to SEQ ID NO: 35787
  derived and/or modified sequence opt4 from anti-influenza_Chain

SEQ ID NO: 35789 - RNA, 1047 nt, Artificial Sequence
  derived and/or modified sequence opt4 from anti-influenza_Chain
augaacaucaagaagaccgccgugaagagcgcccuggccguggccgccgccgccgccgcccugaccaccaacgugagcgccaaggacuucagcggcgccgagcuguacacccuggaggaggugcaguacggcaaguucgaggccagaaugaagauggccgccgccagcggcaccgugagcagcauguuccuguaccagaacggcagcgagaucgccgacggcagacccuggguggagguggacaucgaggugcugggcaagaaccccggcagcuuccagagcaacaucaucaccggcaaggccggcgcccagaagaccagcgagaagcaccacgccgugagccccgccgccgaccaggccuuccacaccuacggccuggaguggacccccaacuacgugagauggaccguggacggccaggaggugagaaagaccgagggcggccaggugagcaaccugaccggcacccagggccugagauucaaccuguggagcagcgagagcgccgccugggugggccaguucgacgagagcaagcugccccuguuccaguucaucaacugggugaagguguacaaguacacccccggccagggcgagggcggcagcgacuucacccuggacuggaccgacaacuucgacaccuucgacggcagcagauggggcaagggcgacuggaccuucgacggcaacagaguggaccugaccgacaagaacaucuacagcagagacggcaugcugauccuggcccugaccagaaagggccaggagagcuucaacggccaggugcccagagacgacgagcccgccccccagagcagcagcagcgcccccgccagcagcagcagcgugcccgccagcagcagcagcgugcccgccagcagcagcagcgccuucgugccccccagcagcagcagcgccaccaacgccauccacggcaugagaaccacccccgccguggccaaggagcacagaaaccuggugaacgccaagggcgccaaggugaaccccaacggccacaagagauacagagugaacuucgagcac

SEQ ID NO: 35790 - RNA, 1047 nt, Artificial Sequence
  derived and/or modified sequence opt4 from anti-influenza_Chain
gaggugcagcugguggagagcggcggcggcguggugcagcccggcagaagccugagacugagcugcgccgccagcggcuucgccuuccacaacagagccaugcacugggugagacaggcccccggcaagggccuggaguggguggcccugaucuacuucgacggcagcaagcaguacuacgccgacagcgugaagggcagauucaccaucagcagagacaacagcaagaacaccguguuccugcagaugaacagccugagacccgaggacaccgccguguacuacugcgccgugcccggccccaucuucggcaucuucccccccuggagcuacuucgaccacuggggccagggcauccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggc

SEQ ID NO: 35791 - RNA, 1047 nt, Artificial Sequence; identical to SEQ ID NO: 35790
  derived and/or modified sequence opt4 from anti-influenza_Chain

SEQ ID NO: 35792 - RNA, 1047 nt, Artificial Sequence; identical to SEQ ID NO: 35789
  derived and/or modified sequence opt4 from anti-influenza_Chain

SEQ ID NO: 35793 - RNA, 1161 nt, Artificial Sequence
  derived and/or modified sequence opt4 from anti-influenza_Chain
augaacaaguuccugaacaagaaguggagccugauccugaccaugggcggcaucuuccugauggccacccugagccugaucuucgccaccggcaagaaggccuucaacgaccagaccagcgccgaggacauccccagccuggccgaggccuucagagacuacuuccccaucggcgccgccaucgagcccggcuacaccaccggccagaucgccgagcuguacaagaagcacgugaacaugcugguggccgagaacgccaugaagcccgccagccugcagcccaccgagggcaacuuccagugggccgacgccgacagaaucgugcaguucgccaaggagaacggcauggagcugagauuccacacccugguguggcacaaccagacccccaccggcuucagccuggacaaggagggcaagcccaugguggaggagaccgacccccagaagagagaggagaacagaaagcugcugcugcagagacuggagaacuacaucagagccguggugcugagauacaaggacgacaucaagagcugggacguggugaacgaggugaucgagcccaacgaccccggcggcaugagaaacagccccugguaccagaucaccggcaccgaguacaucgagguggccuucagagccaccagagaggccggcggcagcgacaucaagcuguacaucaacgacuacaacaccgacgaccccgugaagagagacauccuguacgagcuggugaagaaccugcuggagaagggcgugcccaucgacggcgugggccaccagacccacaucgacaucuacaacccccccguggagagaaucaucgagagcaucaagaaguucgccggccugggccuggacaacaucaucaccgagcuggacaugagcaucuacagcuggaacgacagaagcgacuacggcgacagcauccccgacuacauccugacccugcaggccaagagauaccaggagcuguucgacgcccugaaggagaacaaggacaucgugagcgccgugguguucuggggcaucagcgacaaguacagcuggcugaacggcuuccccgugaagagaaccaacgccccccugcuguucgacagaaacuucaugcccaagcccgccuucugggccaucguggaccccagcagacugagagag

SEQ ID NO: 35794 - RNA, 1161 nt, Artificial Sequence; identical to SEQ ID NO: 35793
  derived and/or modified sequence opt4 from anti-influenza_Chain

SEQ ID NO: 35795 - RNA, 1221 nt, Artificial Sequence
  derived and/or modified sequence opt4 from anti-influenza_Chain
augagaaacguggugagaaagccccugaccaucggccuggcccugacccugcugcugcccaugggcaugaccgccaccagcgccaagaacgccgacagcuacgccaagaagccccacaucagcgcccugaacgccccccagcuggaccagagauacaagaacgaguucaccaucggcgccgccguggagcccuaccagcugcagaacgagaaggacgugcagaugcugaagagacacuucaacagcaucguggccgagaacgugaugaagcccaucagcauccagcccgaggagggcaaguucaacuucgagcaggccgacagaaucgugaaguucgccaaggccaacggcauggacaucagauuccacacccugguguggcacagccaggugccccagugguucuuccuggacaaggagggcaagcccauggugaacgagaccgaccccgugaagagagagcagaacaagcagcugcugcugaagagacuggagacccacaucaagaccaucguggagagauacaaggacgacaucaaguacugggacguggugaacgagguggugggcgacgacggcaagcugagaaacagccccugguaccagaucgccggcaucgacuacaucaagguggccuuccaggccgccagaaaguacggcggcgacaacaucaagcuguacaugaacgacuacaacaccgagguggagcccaagagaaccgcccuguacaaccuggugaagcagcugaaggaggagggcgugcccaucgacggcaucggccaccagagccacauccagaucggcuggcccagcgaggccgagaucgagaagaccaucaacauguucgccgcccugggccuggacaaccagaucaccgagcuggacgugagcauguacggcuggccccccagagccuaccccaccuacgacgccauccccaagcagaaguuccuggaccaggccgccagauacgacagacuguucaagcuguacgagaagcugagcgacaagaucagcaacgugaccuucuggggcaucgccgacaaccacaccuggcuggacagcagagccgacguguacuacgacgccaacggcaacguggugguggaccccaacgcccccuacgccaagguggagaagggcaagggcaaggacgcccccuucguguucggccccgacuacaaggugaagcccgccuacugggccaucaucgaccacaag

SEQ ID NO: 35796 - RNA, 1221 nt, Artificial Sequence; identical to SEQ ID NO: 35795
  derived and/or modified sequence opt4 from anti-influenza_Chain

SEQ ID NO: 35797 - RNA, 1233 nt, Artificial Sequence
  derived and/or modified sequence opt4 from anti-influenza_Chain
cugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcuacauccccgaggcccccagagacggccaggccuacgugagaaaggacggcgagugggugcugcugagcaccuuccugagaagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35798 - RNA, 1233 nt, Artificial Sequence; identical to SEQ ID NO: 35797
  derived and/or modified sequence opt4 from anti-influenza_Chain

SEQ ID NO: 35799 - RNA, 1293 nt, Artificial Sequence
  derived and/or modified sequence opt4 from anti-influenza_Chain
auggacgaccacgccgagaaguuccuguggggcguggccaccagcgccuaccagaucgagggcgccacccaggaggacggcagaggccccagcaucugggacgccuucgccagaagacccggcgccaucagagacggcagcaccggcgagcccgccugcgaccacuacagaagauacgaggaggacaucgcccugaugcagagccugggcgugagagccuacagauucagcguggccuggcccagaauccugcccgagggcagaggcagaaucaaccccaagggccuggccuucuacgacagacugguggacagacugcuggccagcggcaucacccccuuccugacccuguaccacugggaccugccccuggcccuggaggagagaggcggcuggagaagcagagagaccgccuucgccuucgccgaguacgccgaggccguggccagagcccuggccgacagagugcccuucuucgccacccugaacgagcccuggugcagcgccuuccugggccacuggaccggcgagcacgcccccggccugagaaaccuggaggccgcccugagagccgcccaccaccugcugcugggccacggccuggccguggaggcccugagagccgccggcgccagaagagugggcaucgugcugaacuucgcccccgccuacggcgaggaccccgaggccguggacguggccgacagauaccacaacagauacuuccuggaccccauccugggcaagggcuaccccgagagccccuucagagaccccccccccgugcccauccugagcagagaccuggagcugguggccagaccccuggacuuccugggcgugaacuacuacgcccccgugagaguggcccccggcaccggcacccugcccgugagauaccugccccccgagggccccgccaccgccaugggcugggagguguaccccgagggccugcaccaccugcugaagagacugggcagagaggugcccuggccccuguacgugaccgagaacggcgccgccuaccccgaccuguggaccggcgaggccgugguggaggaccccgagagaguggccuaccuggaggcccacguggaggccgcccugagagccagagaggagggcguggaccugagaggcuacuucguguggagccugauggacaacuucgagugggccuucggcuacaccagaagauucggccuguacuacguggacuuccccagccagagaagaauccccaagagaagcgcccugugguacagagagagaaucgccagagcccagacc

SEQ ID NO: 35800 - RNA, 1293 nt, Artificial Sequence
  derived and/or modified sequence opt4 from anti-influenza_Chain
augaccgagaacgccgagaaguuccuguggggcguggccaccagcgccuaccagaucgagggcgccacccaggaggacggcagaggccccagcaucugggacgccuucgcccagagacccggcgccaucagagacggcagcaccggcgagcccgccugcgaccacuacagaagauacgaggaggacaucgcccugaugcagagccugggcgugagagccuacagauucagcguggccuggcccagaauccugcccgagggcagaggcagaaucaaccccaagggccuggccuucuacgacagacugguggacagacugcuggccagcggcaucacccccuuccugacccuguaccacugggaccugccccuggcccuggaggagagaggcggcuggagaagcagagagaccgccuucgccuucgccgaguacgccgaggccguggccagagcccuggccgacagagugcccuucuucgccacccugaacgagcccuggugcagcgccuuccugggccacuggaccggcgagcacgcccccggccugagaaaccuggaggccgcccugagagccgcccaccaccugcugcugggccacggccuggccguggaggcccugagagccgccggcgccagaagagugggcaucgugcugaacuucgcccccgccuacggcgaggaccccgaggccguggacguggccgacagauaccacaacagauucuuccuggaccccauccugggcaagggcuaccccgagagccccuucagagaccccccccccgugcccauccugagcagagaccuggagcugguggccagaccccuggacuuccugggcgugaacuacuacgcccccgugagaguggcccccggcaccggcacccugcccgugagauaccugccccccgagggccccgccaccgccaugggcugggagguguaccccgagggccuguaccaccugcugaagagacugggcagagaggugcccuggccccuguacgugaccgagaacggcgccgccuaccccgaccuguggaccggcgaggccgugguggaggaccccgagagaguggccuaccuggaggcccacguggaggccgcccugagagccagagaggagggcguggaccugagaggcuacuucguguggagccugauggacaacuucgagugggccuucggcuacaccagaagauucggccuguacuacguggacuuccccagccagagaagaauccccaagagaagcgcccugugguacagagagagaaucgccagagcccagacc

SEQ ID NO: 35801 - RNA, 1293 nt, Artificial Sequence
  derived and/or modified sequence opt4 from anti-influenza_Chain
auggccgagaacgccgagaaguuccuguggggcguggccaccagcgccuaccagaucgagggcgccacccaggaggacggcagaggccccagcaucugggacaccuucgccagaagacccggcgccaucagagacggcagcaccggcgagcccgccugcgaccacuaccacagauacgaggaggacaucgcccugaugcagagccugggcgugggcguguacagauucagcguggccuggcccagaauccugcccgagggcagaggcagaaucaaccccaagggccuggccuucuacgacagacugguggacagacugcuggccgccggcaucacccccuuccugacccuguaccacugggaccugccccaggcccuggaggacagaggcggcuggagaagcagagagaccgccuucgccuucgccgaguacgccgaggccguggccagagcccuggccgacagagugcccuucuucgccacccugaacgagcccuggugcagcgccuuccugggccacuggaccggcgagcacgcccccggccugagaaaccuggaggccgcccugagagccgcccaccaccugcugcugggccacggccuggccguggaggcccugagagccgccggcgccaagagagugggcaucgugcugaacuucgcccccguguacggcgaggaccccgaggccguggacguggccgacagauaccacaacagauacuuccuggaccccauccugggcagaggcuaccccgagagccccuuccaggaccccccccccacccccaaccugagcagagaccuggagcugguggccagaccccuggacuuccugggcgugaacuacuacgcccccgugagaguggcccccggcaccggcccccugcccgugagauaccugccccccgagggccccgugaccgccaugggcugggagguguaccccgagggccuguaccaccugcugaagagacugggcagagaggugcccuggccccuguacaucaccgagaacggcgccgccuaccccgaccuguggaccggcgaggccgugguggaggaccccgagagaguggccuaccuggaggcccacguggaggccgcccugagagccagagaggagggcguggaccugagaggcuacuucguguggagccugauggacaacuucgagugggccuucggcuacaccagaagauucggccuguacuacguggacuuccccagccagagaagaauccccaagagaagcgcccugugguacagagagagaaucgccagagcccagcug

SEQ ID NO: 35802 - RNA, 1293 nt, Artificial Sequence; identical to SEQ ID NO: 35799
  derived and/or modified sequence opt4 from anti-influenza_Chain

SEQ ID NO: 35803 - RNA, 1293 nt, Artificial Sequence; identical to SEQ ID NO: 35800
  derived and/or modified sequence opt4 from anti-influenza_Chain

SEQ ID NO: 35804 - RNA, 1293 nt, Artificial Sequence; identical to SEQ ID NO: 35801
  derived and/or modified sequence opt4 from anti-influenza_Chain

SEQ ID NO: 35805 - RNA, 1296 nt, Artificial Sequence
  derived and/or modified sequence opt4 from anti-influenza_Chain
auguucaagcccaacuaccacuucuuccccaucaccggcuggaugaacgaccccaacggccugaucuucuggaagggcaaguaccacauguucuaccaguacaaccccagaaagcccgaguggggcaacaucugcuggggccacgccgugagcgacgaccuggugcacuggagacaccugcccguggcccuguaccccgacgacgagacccacggcguguucagcggcagcgccguggagaaggacggcaagauguuccugguguacaccuacuacagagaccccacccacaacaagggcgagaaggagacccagugcguggccaugagcgagaacggccuggacuucgugaaguacgacggcaaccccgugaucagcaagccccccgaggagggcacccacgccuucagagaccccaaggugaacagaagcaacggcgaguggagaauggugcugggcagcggcaaggacgagaagaucggcagagugcugcuguacaccagcgacgaccuguuccacuggaaguacgagggcgugaucuucgaggacgagaccaccaaggagaucgagugccccgaccuggugagaaucggcgagaaggacauccugaucuacagcaucaccagcaccaacagcgugcuguucagcaugggcgagcugaaggagggcaagcugaacguggagaagagaggccugcuggaccacggcaccgacuucuacgccgcccagaccuucuucggcaccgacagagugguggugaucggcuggcugcagagcuggcugagaaccggccuguaccccaccaagagagagggcuggaacggcgugaugagccugcccagagagcuguacguggagaacaacgagcugaaggugaagcccguggacgagcugcuggcccugagaaagagaaagguguucgagaccgccaagagcggcaccuuccugcuggacgugaaggagaacagcuacgagaucgugugcgaguucagcggcgagaucgagcugagaaugggcaacgagagcgaggagguggugaucaccaagagcagagacgagcugaucguggacaccaccagaagcggcgugagcggcggcgaggugagaaagagcaccguggaggacgaggccaccaacagaaucagagccuuccuggacagcugcagcguggaguucuucuucaacgacagcaucgccuucagcuucagaauccaccccgagaacguguacaacauccugagcgugaagagcaaccaggugaagcuggagguguucgagcuggagaacaucuggcug

SEQ ID NO: 35806 - RNA, 1296 nt, Artificial Sequence; identical to SEQ ID NO: 35805
  derived and/or modified sequence opt4 from anti-influenza_Chain

SEQ ID NO: 35807 - RNA, 1323 nt, Artificial Sequence
  derived and/or modified sequence opt4 from anti-influenza_Chain
gaggugaagcugguggagagcggcggcggccuggugcagcccggcggcagccugagacugagcugcgccaccagcggcuucaccuucagcgacuacuacaugagcugggugagacagagccccggcaaggcccuggaguggcugggcuucaccagaagcagagugcugggcuacaccaccgacuacagcgccagcgugaagggcagauucaccaucagcagagacaacagccagagcauccuguaccugcagaugaacagccugagaggcgaggacagcgccaccuacuacugcgccagagacagacccauggacuacuggggccagggcaccagcgugaccgugagcagcgccaagaccaccccccccagcguguacccccuggcccccggcagcgccgcccagaccaacagcauggugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagcaccuggcccagcgagaccgugaccugcaacguggcccaccccgccagcagcaccaagguggacaagaagaucgugcccagagacugcggcugcaagcccugcaucugcaccgugcccgaggugagcagcguguucaucuucccccccaagcccaaggacgugcugaccaucacccugacccccaaggugaccugcguggugguggacaucagcaaggacgaccccgaggugcaguucagcugguucguggacgacguggaggugcacaccgcccagacccagcccagagaggagcaguucaacagcaccuucagaagcgugagcgagcugcccaucaugcaccaggacuggcugaacggcaaggaguucaagugcagagugaacagcgccgccuuccccgcccccaucgagaagaccaucagcaagaccaagggcagacccaaggccccccagguguacaccauccccccccccaaggagcagauggccaaggacaaggugagccugaccugcaugaucaccgacuucuuccccgaggacaucaccguggaguggcaguggaacggccagcccgccgagaacuacaagaacacccagcccaucauggacaccgacggcagcuacuucguguacagcaagcugaacgugcagaagagcaacugggaggccggcaacaccuucaccugcagcgugcugcacgagggccugcacaaccaccacaccgagaagagccugagccacagccccggcaag

SEQ ID NO: 35808 - RNA, 1323 nt, Artificial Sequence; identical to SEQ ID NO: 35807
  derived and/or modified sequence opt4 from anti-influenza_Chain

SEQ ID NO: 35809 - RNA, 1329 nt, Artificial Sequence
  derived and/or modified sequence opt4 from anti-influenza_Chain
gaggugcagcugcagcagagcggccccgagcuggugaagcccggcgccagcgugaagaugagcugcaaggccagcggcuacaccuucaccagcuacgugaugcacugggugaagcagaagcccggccagggccuggaguggaucggcuacaucaaccccuacaacgacggcaccagauacaacgagaaguucagagugaaggccacccugaccagcgacaagagcagcagcaccgccuacauggagcugagcagccugaccagcgaggacagcgccguguacuacugcgccagaagaggccugaucaccacccccacccuggacuacuggggccagggcaccacccugaccgugagcagcgccaagaccaccccccccagcguguacccccuggcccccggcagcgccgcccagaccaacagcauggugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagcaccuggcccagcgagaccgugaccugcaacguggcccaccccgccagcagcaccaagguggacaagaagaucgugcccagagacugcggcugcaagcccugcaucugcaccgugcccgaggugagcagcguguucaucuucccccccaagcccaaggacgugcugaccaucacccugacccccaaggugaccugcguggugguggacaucagcaaggacgaccccgaggugcaguucagcuggguggacgacguggaggugcacaccgcccagacccagcccagagaggagcaguucaacagcaccuucagaagcgugagcgagcugcccaucaugcaccaggacuggcugaacggcaaggaguucaagugcagagugaacagcgccgccuuccccgcccccaucgagaagaccaucagcaagaccaagggcagacccaaggccccccagguguacaccauccccccccccaaggagcagauggccaaggacaaggugagccugaccugcaugaucaccgacuucuuccccgaggacaucaccguggaguggcaguggaacggccagcccgccgagaacuacaagaacacccagcccaucauggacaccgacggcagcuacuucguguacagcaagcugaacgugcagaagagcaacugggaggccggcaacaccuucaccugcagcgugcugcacgagggccugcacaaccaccacaccgagaagagccugagccacagccccggcaag

SEQ ID NO: 35810 - RNA, 1329 nt, Artificial Sequence; identical to SEQ ID NO: 35809
  derived and/or modified sequence opt4 from anti-influenza_Chain

SEQ ID NO: 35811 - RNA, 1332 nt, Artificial Sequence
  derived and/or modified sequence opt4 from anti-influenza_Chain
aacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcuacauccccgaggcccccagagacggccaggccuacgugagaaaggacggcgagugggugcugcugagcaccuuccugagaagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35812 - RNA, 1332 nt, Artificial Sequence; identical to SEQ ID NO: 35811
  derived and/or modified sequence opt4 from anti-influenza_Chain

SEQ ID NO: 35813 - RNA, 1341 nt, Artificial Sequence
  derived and/or modified sequence opt4 from anti-influenza_Chain
caggugcagcugcaggagagcggccccggccuggugaagcccagcgagacccugagccugaccugcaccgugagcggcggccugaucggcaccggcagcuacuacuggggcuggaucagacagacccccggcaagggcauggaguggaucggcagcaucagcuacagcggcagcaccuacuaccaccccagccugaagagcagagugaccaucagcgacgacaccagcaagaaccagcuguuccugaagcugagaagcgugaccgccgccgacaccgcccaguacuacugcgccagauacaacuggggcaucagauacuucgacuucuggggcagaggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagaccagagagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccgcccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 35814 - RNA, 1341 nt, Artificial Sequence; identical to SEQ ID NO: 35813
  derived and/or modified sequence opt4 from anti-influenza_Chain

SEQ ID NO: 35815 - RNA, 1344 nt, Artificial Sequence
  derived and/or modified sequence opt4 from anti-influenza_Chain
gaggugcagcugcaggagagcggccccggccuggugaagcccagccagacccugagccugaccugcaacgugagcggcggcagcaucaccggcgacuacaaguggagcuggaucagacagccccccggcaagggccuggaguggaucggccacauccacagcaccggcaccaccuacuacaaccccagccugagaagcagaaucaccaucagcauggacaccagcaagaacaaccugagccugagacugaccagcgugaccgccgccgacaccgccguguacuacugcgccagccacacccugaccagcggccacuaccccagagacuucgacuucuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugaccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcauggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagcggcaag

SEQ ID NO: 35816 - RNA, 1350 nt, Artificial Sequence
  derived and/or modified sequence opt4 from anti-influenza_Chain
caggugcagcugcagcagagcggcgccgaggugaagaagcccggcagcagcgugaaggugagcugcaaggugagcggcgugaucuucagcggcagcgccaucagcugggugagacaggcccccggccagggccuggaguggaugggcggcaucagcccccuguucggcaccaccaacuacgcccagaaguuccagggcagagugaccaucaccgccgaccagagcaccaacaccaccuacauggaggugaacagccugagauacgaggacaccgccguguacuucugcgccagaggccccaaguacuacagcgaguacauggacguguggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35817 - RNA, 1350 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggcaccuucagcagcuacgccaucagcugggugagacaggcccccggccagggccuggaguggaugggcggcaucaugggcauguucggcaccaccaacuacgcccagaaguuccagggcagagugaccaucaccgccgacgaguucaccagcgccgccuacauggagcugagaagccugagaagcgaggacaccgccguguacuacugcgccagaagcagcggcuacuaccccgaguacuuccaggacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35818 - RNA, 1350 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaccuucagcagcuacggcaucagcugggugagacaggcccccggccagggccuggaguggaugggcgacaucaucggcauguucggcagcaccaacuacgcccagaacuuccagggcagacugaccaucaccgccgacgagagcaccagcaccgccuacauggagcugagcagccugagaagcgaggacaccgccguguacuacugcgccagaagcagcggcuacuaccccgccuaccugccccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35819 - RNA, 1350 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaccuucagcagcuacgccaucagcugggugagacaggcccccggccagggccuggaguggaugggcggcaucaucggcauguucggcaccgccaacuacgcccagaaguuccagggcagagugaccaucaccgccgacgaguucaccagcaccgccuacauggagcugagcagccugagaagcgaggacaccgccguguacuacugcgccagaggcaacuacuacuacgagagcagccuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35820 - RNA, 1350 nt, Artificial Sequence
  derived and/or modified sequence opt4 from anti-influenza_Chain
gaggugcagcuggugcagagcggcgccgaggugaagaagcccggcagcagcaugaaggugagcugcaaggccagcggcagcaucuucagcaacuacggcaucagcugggugagacaggcccccggccagggccuggaguggaugggcggcaucauccccaucuucggcgccgccaacuacgcccagaaguuccagggcagagugaccaucaccgccgacgagagcaccagcaccguguacauggaggugagaagccugagaagcgaggacaccgccguguacuacugcgccagaagacagcagcuguacaagggcuacuaccaccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35821 - RNA, 1350 nt, Artificial Sequence
  derived and/or modified sequence opt4 from anti-influenza_Chain
caggugcagcuggugcagagcggcgccggcgugaagaagcccggcagcagcaugaaggugagcugcaaggccagcggcagcaucuucagcaacuacggcaucagcugggugagacaggcccccggccagggccuggaguggaugggcggcaucauccccaucuucggcgccgccaacuacgcccagaaguuccagggcagagugaccaucaccgccgacgagagcaccagcaccguguacauggaggugagaagccugagaagcgaggacaccgccguguacuacugcgccagaagacagcagcuguacaagggcuacuaccaccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35822 - RNA, 1350 nt, Artificial Sequence
  derived and/or modified sequence opt4 from anti-influenza_Chain
caggugcagcuggugcagagcggcgccgaggugagaaagcccggcagcagcgugaaggugagcugcaaggugagcggcggcaucaucagaaaguacgccaucaacugggugagacaggcccccggccagggccuggaguggaugggcggcaucaucgccaucuucaacaccgccaacuacgcccagaaguuccagggcagagugaccaucaccgccgacgagagcaccagcaccguguacauggagcugagcagccugagaagcgaggacaccgcccuguacuacugcgccagaggcaugaacuacuacagcgacuacuucgacuacuggggccagggcagccuggugaccgugagccccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35823 - RNA, 1350 nt, Artificial Sequence; identical to SEQ ID NO: 35822
  derived and/or modified sequence opt4 from anti-influenza_Chain

SEQ ID NO: 35824 - RNA, 1350 nt, Artificial Sequence; identical to SEQ ID NO: 35820
  derived and/or modified sequence opt4 from anti-influenza_Chain

SEQ ID NO: 35825 - RNA, 1350 nt, Artificial Sequence; identical to SEQ ID NO: 35821
  derived and/or modified sequence opt4 from anti-influenza_Chain

SEQ ID NO: 35826 - RNA, 1350 nt, Artificial Sequence; identical to SEQ ID NO: 35816
  derived and/or modified sequence opt4 from anti-influenza_Chain

SEQ ID NO: 35827 - RNA, 1350 nt, Artificial Sequence; identical to SEQ ID NO: 35817
  derived and/or modified sequence opt4 from anti-influenza_Chain

SEQ ID NO: 35828 - RNA, 1350 nt, Artificial Sequence; identical to SEQ ID NO: 35818
  derived and/or modified sequence opt4 from anti-influenza_Chain

SEQ ID NO: 35829 - RNA, 1350 nt, Artificial Sequence; identical to SEQ ID NO: 35819
  derived and/or modified sequence opt4 from anti-influenza_Chain

SEQ ID NO: 35830 - RNA, 1353 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35831 - RNA, 1353 nt, Artificial Sequence
  derived and/or modified sequence opt4 from anti-influenza_Chain
caggugcagcuggugcagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35832 - RNA, 1353 nt, Artificial Sequence
  derived and/or modified sequence opt4 from anti-influenza_Chain
gaggugcagcugguggagagcggcgccgaggugaagaagcccggcagcagcgugaaggugagcugcaaggccagcggcggcaccuucagcuucuacagcaugagcugggugagacaggcccccggccagggccuggaguggaugggcggcaucauccccauguucggcaccaccaacuacgcccagaaguuccagggcagagugaccaucaccgccguggagagcaccagcaccgccuacauggaggugagcagccugagaagcgaggacaccgccguguacuacugcgccagaggcgacaagggcaucuacuacuacuacauggacguguggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35833 - RNA, 1353 nt, Artificial Sequence; identical to SEQ ID NO: 35830
  derived and/or modified sequence opt4 from anti-influenza_Chain

SEQ ID NO: 35834 - RNA, 1353 nt, Artificial Sequence; identical to SEQ ID NO: 35831
  derived and/or modified sequence opt4 from anti-influenza_Chain

SEQ ID NO: 35835 - RNA, 1353 nt, Artificial Sequence; identical to SEQ ID NO: 35832
  derived and/or modified sequence opt4 from anti-influenza_Chain

SEQ ID NO: 35836 - RNA, 1356 nt, Artificial Sequence
  derived and/or modified sequence opt4 from anti-influenza_Chain
caggugcagcuggugcagagcggcggcggccuggugaagcccggcggcagccugagacugagcugcgccgccagcggcuucaccuucagcagcuacagcaugaacugggugagacaggcccccggcaagggccuggagugggugagcagcaucagcagcagcagcagcuacaucuacuacguggacagcgugaagggcagauucaccaucagcagagacaacgccaagaacagccuguaccugcagaugaacagccugagagccgaggacaccgccguguacuacugcgccagaggcggcggcagcuacggcgccuacgagggcuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35837 - RNA, 1356 nt, Artificial Sequence
  derived and/or modified sequence opt4 from anti-influenza_Chain
caggugcagcuggugcagagcggcgccgaggugaagcagcccggcgccagcgugaaggugagcugcaaggccagcggcuacaccuucaacgccuacuacauccacugggugagacaggcccccggccagggccuggaguggaugggcuggaucaaccccaacuucggcggcacccacuacgccagaaaguuccagggcagagugaccaugaccagagacgccagcaucaacaccgccuacauggagcuggacagacugaucagcgacgacaccgccguguacuacugcgugagauggagagccgccgccgugaucauggaccaguucuacaagauggacguguggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagaccagagagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccgcccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 35838 - RNA, 1356 nt, Artificial Sequence
  derived and/or modified sequence opt4 from anti-influenza_Chain
gaggugcagcuggugcagagcggcgccgaggugaagaagcccggcgccagcgugaaggugagcugcaaggccagcggcuacaucuucaccggcuacuacauccacugggugagacaggcccccggccagggccuggaguggaugggcagaaucgaccccaacggcgccggcaccaccuacgcccagaaguuccagggcagagugacccugaccauggacaccagcaucaccaccgccuacauggagcugagcagacugagauucgacgacaccgccaucuacuacugcgccagaugggacuggaacuucgaccuguaccugggcugguucgaccccuggggccagggcacccccgugaccguggccagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugcgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35839 - RNA, 1356 nt, Artificial Sequence; identical to SEQ ID NO: 35837
  derived and/or modified sequence opt4 from anti-influenza_Chain

SEQ ID NO: 35840 - RNA, 1356 nt, Artificial Sequence; identical to SEQ ID NO: 35836
  derived and/or modified sequence opt4 from anti-influenza_Chain

SEQ ID NO: 35841 - RNA, 1356 nt, Artificial Sequence; identical to SEQ ID NO: 35838
  derived and/or modified sequence opt4 from anti-influenza_Chain

SEQ ID NO: 35842 - RNA, 1359 nt, Artificial Sequence
  derived and/or modified sequence opt4 from anti-influenza_Chain
caggugcagcuggugcagagcggcgccgaggugaagaagcccggcagcagcgugagagugagcugcaaggccagcggcagcaucuucagaaacuacgccaugagcugggugagacaggcccccggccagggccuggaguggaugggcggcaucaucgccaucuucggcacccccaaguacgcccagaaguuccagggcagagugaccaucaccgccgacgagagcaccagcaccguguacauggagcugagcggccugagaagcgaggacaccgccauguacuacugcgccagaaucccccacuacaacuucggcagcggcagcuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35843 - RNA, 1359 nt, Artificial Sequence
  derived and/or modified sequence opt4 from anti-influenza_Chain
caggugcagcuggugcagagcggcgccgaggugaagaagcccggcgccagcgugaaggugagcugcaaggccagcggcuacaucuucaccggcuacuacauccacugggugagacaggcccccggccagggccuggaguggaugggcagaaucgaccccaacggcagcggcaccaccuacgcccagaaguuccagggcagagugacccugaccauggacaccagcaucaccaccgccuacauggagcugagcagacugagauucgacgacaccgccaucuacuacugcgccagaugggacuggaacuucgaccuguaccugggcugguucgaccccuggggccagggcacccccgugaccguggccagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35844 - RNA, 1359 nt, Artificial Sequence
  derived and/or modified sequence opt4 from anti-influenza_Chain
gaggugcagcuggugcagagcggcgccgaggugaagaagcccggcgccagcgugaaggugagcugcaaggccagcggcuacaucuucaccggcuacuacauccacugggugagacaggcccccggccagggccuggaguggaugggcagaaucgaccccaacggcgccggcaccaccuacgcccagaaguuccagggcagagugacccugaccauggacaccagcaucaccaccgccuacauggagcugagcagacugagauucgacgacaccgccaucuacuacugcgccagaugggacuggaacuucgaccuguaccugggcugguucgaccccuggggccagggcacccccgugaccguggccagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35845 - RNA, 1359 nt, Artificial Sequence
  derived and/or modified sequence opt4 from anti-influenza_Chain
caggugcagcuggugcagagcggcgccgaggugaagaagcccggcgccagcgugaaggugagcugcaaggccagcggcuacaccuucaacgcccaccacaugcacugggugagacaggcccccggccagggccugggcuggaugggcuggaucgaccccaacaacgacggcaccaucuacgcccagaaguuccagggcagagugacccugaccauggacaccagcauccacaccgccuacauggagcugagcggccugagauacgacgacaccgccaucuacuacugcgugagaugggccuggaacuucgacuucuuccugggcugguucgaccccuggggccagggcacccuggugaccguggccagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35846 - RNA, 1359 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgacagcgacaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35847 - RNA, 1359 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgacgccgacgccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35848 - RNA, 1359 nt, Artificial Sequence; identical to SEQ ID NO: 31591
  derived and/or modified sequence opt4 from anti-influenza_Chain

SEQ ID NO: 35849 - RNA, 1359 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgacgccgacaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35850 - RNA, 1359 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcagcagcgacaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35851 - RNA, 1359 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgacagcgacgccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35852 - RNA, 1359 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgacaccgacaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35853 - RNA, 1359 nt, Artificial Sequence
  derived and/or modified sequence opt4 from anti-influenza_Chain
gaggugcagcuggugcagagcggcgccgaggugaagaagcccggcgagagccugaagaucagcugcaaggugagcggcuacagcuucaccagccaguggaucggcugggugagacagaugcccggcaagggccuggaguggaucggcaugauguaccccggcgagagcgacaccaucuacagccccagcuuccagggccaggugaccaucagcgccgacaacagcaucagcaccgccuaccugcaguggagcagccugaaggccagcgacaccgccaucuacuacugcgccagcggccccggcuacagcggcuaccacuacggcugguucgacaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35854 - RNA, 1359 nt, Artificial Sequence; identical to SEQ ID NO: 35842
  derived and/or modified sequence opt4 from anti-influenza_Chain

SEQ ID NO: 35855 - RNA, 1359 nt, Artificial Sequence; identical to SEQ ID NO: 35843
  derived and/or modified sequence opt4 from anti-influenza_Chain

SEQ ID NO: 35856 - RNA, 1359 nt, Artificial Sequence; identical to SEQ ID NO: 35844
  derived and/or modified sequence opt4 from anti-influenza_Chain

SEQ ID NO: 35857 - RNA, 1359 nt, Artificial Sequence; identical to SEQ ID NO: 35845
  derived and/or modified sequence opt4 from anti-influenza_Chain

SEQ ID NO: 35858 - RNA, 1359 nt, Artificial Sequence; identical to SEQ ID NO: 35846
  derived and/or modified sequence opt4 from anti-influenza_Chain

SEQ ID NO: 35859 - RNA, 1359 nt, Artificial Sequence; identical to SEQ ID NO: 35847
  derived and/or modified sequence opt4 from anti-influenza_Chain

SEQ ID NO: 35860 - RNA, 1359 nt, Artificial Sequence; identical to SEQ ID NO: 31591
  derived and/or modified sequence opt4 from anti-influenza_Chain

SEQ ID NO: 35861 - RNA, 1359 nt, Artificial Sequence; identical to SEQ ID NO: 35849
  derived and/or modified sequence opt4 from anti-influenza_Chain

SEQ ID NO: 35862 - RNA, 1359 nt, Artificial Sequence; identical to SEQ ID NO: 35850
  derived and/or modified sequence opt4 from anti-influenza_Chain

SEQ ID NO: 35863 - RNA, 1359 nt, Artificial Sequence; identical to SEQ ID NO: 35851
  derived and/or modified sequence opt4 from anti-influenza_Chain

SEQ ID NO: 35864 - RNA, 1359 nt, Artificial Sequence; identical to SEQ ID NO: 35852
  derived and/or modified sequence opt4 from anti-influenza_Chain

SEQ ID NO: 35865 - RNA, 1359 nt, Artificial Sequence; identical to SEQ ID NO: 35853
  derived and/or modified sequence opt4 from anti-influenza_Chain

SEQ ID NO: 35866 - RNA, 1365 nt, Artificial Sequence
  derived and/or modified sequence opt4 from anti-influenza_Chain
caggugcagcugguggagagcggcggcggcguggugcagcccggcagaagccugagacugagcugcgccgccagcggcuucgccuuccacaacagagccaugcacugggugagacaggcccccggcaagggccuggaguggguggcccugaucuacuucgacggcagcaagcaguacuacgccgacagcgugaagggcagauucaccaucagcagagacaacagcaagaacaccguguuccugcagaugaacagccugagacccgaggacaccgccguguacuacugcgccgugcccggccccaucuucggcaucuucccccccuggagcuacuucgaccacuggggccagggcauccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35867 - RNA, 1365 nt, Artificial Sequence
  derived and/or modified sequence opt4 from anti-influenza_Chain
gaggugcagcugguggagagcggcggcggcguggugcagcccggcagaagccugagacugagcugcgccgccagcggcuucgccuuccacaacagagccaugcacugggugagacaggcccccggcaagggccuggaguggguggcccugaucuacuucgacggcagcaagcaguacuacgccgacagcgugaagggcagauucaccaucagcagagacaacagcaagaacaccguguuccugcagaugaacagccugagacccgaggacaccgccguguacuacugcgccgugcccggccccaucuucggcaucuucccccccuggagcuacuucgaccacuggggccagggcauccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35868 - RNA, 1365 nt, Artificial Sequence
  derived and/or modified sequence opt4 from anti-influenza_Chain
gaggugcagcuggugcagagcggcggcggcguggugcagcccggcaagagccugagacugagcugcgccgccagcggccugaccuucagcagcuacgccgugcacugggugagacaggcccccggcaagggccuggagugggugacccugaucagcuacgacggcgccaaccaguacuacgccgacagcgugaagggcagauucaccaucagcagagacaacagcaagaacaccguguaccugcagaugaacagccugagacccgaggacaccgccguguacuacugcgccgugcccggccccguguucggcaucuucccccccuggagcuacuucgacaacuggggccagggcauccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35869 - RNA, 1365 nt, Artificial Sequence
  derived and/or modified sequence opt4 from anti-influenza_Chain
caggugcagcugguggagagcggcggcggcguggugcagcccggcaagagccugagacugagcugcgccgccagcggccugaccuucagcagcuacgccgugcacugggugagacaggcccccggcaagggccuggagugggugacccugaucagcuacgacggcgccaaccaguacuacgccgacagcgugaagggcagauucaccaucagcagagacaacagcaagaacaccguguaccugcagaugaacagccugagacccgaggacaccgccguguacuacugcgccgugcccggccccguguucggcaucuucccccccuggagcuacuucgacaacuggggccagggcauccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35870 - RNA, 1365 nt, Artificial Sequence
  derived and/or modified sequence opt4 from anti-influenza_Chain
caggugcagcugguggagagcggcggcggcguggugcagcccggcaagagccccagacugagcugcgccgccagcggccccaccuucagcagcuacgccgugcacugggugagacaggcccccggcaagggccuggagugggugacccugaucagcuacgacggcgccaaccaguacuacgccgacagcgugaagggcagauucaccaucagcagagacaacagcaagaacaccguguaccugcagaugaacagccugagacccgaggacaccgccguguacuacugcgccgugcccggccccguguucggcaucuucccccccuggagcuacuucgacaacuggggccagggcauccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35871 - RNA, 1365 nt, Artificial Sequence; identical to SEQ ID NO: 31575
  derived and/or modified sequence opt4 from anti-influenza_Chain

SEQ ID NO: 35872 - RNA, 1365 nt, Artificial Sequence
  derived and/or modified sequence opt4 from anti-influenza_Chain
caggugcagcuggugcagagcggcgccgagcugaagagacccggcgccagcgugaaggugagcugcaagaccagcggcuacagcuucaacaacuacggcaucaacugggugagacaggcccccggccagggccuggaguggaugggcuggaucagcgccuacaccggcaacacccacuacgccaagaacuucgagggcagagugacccugaccaccgacaccagcaccagcaccgccuacauggaggugagaagccugagaagcgacgacagcgccguguacuucugcgccagagccaugauccagggcguggugacccuguaccugagacccggcgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35873 - RNA, 1365 nt, Artificial Sequence; identical to SEQ ID NO: 35866
  derived and/or modified sequence opt4 from anti-influenza_Chain

SEQ ID NO: 35874 - RNA, 1365 nt, Artificial Sequence; identical to SEQ ID NO: 35867
  derived and/or modified sequence opt4 from anti-influenza_Chain

SEQ ID NO: 35875 - RNA, 1365 nt, Artificial Sequence; identical to SEQ ID NO: 35868
  derived and/or modified sequence opt4 from anti-influenza_Chain

SEQ ID NO: 35876 - RNA, 1365 nt, Artificial Sequence; identical to SEQ ID NO: 35869
  derived and/or modified sequence opt4 from anti-influenza_Chain

SEQ ID NO: 35877 - RNA, 1365 nt, Artificial Sequence; identical to SEQ ID NO: 35870
  derived and/or modified sequence opt4 from anti-influenza_Chain

SEQ ID NO: 35878 - RNA, 1365 nt, Artificial Sequence; identical to SEQ ID NO: 31575
  derived and/or modified sequence opt4 from anti-influenza_Chain

SEQ ID NO: 35879 - RNA, 1365 nt, Artificial Sequence; identical to SEQ ID NO: 35872
  derived and/or modified sequence opt4 from anti-influenza_Chain

SEQ ID NO: 35880 - RNA, 1368 nt, Artificial Sequence
  derived and/or modified sequence opt4 from anti-influenza_Chain
gaggugcagcuggugcagagcggcggcggcguggugcagcccagaagaagccugagacugagcugcgccgccagcggcuucaccuucagcagcuacgccaugcacugggugagacaggcccccggcaagggccuggaguggguggccgugaucagcuacgacggcagaaacaaguacuacgccgacagcgugaagggcagauucaccgugagcagagacaacagcaagaacacccuguaccugcagaugaacagccugagagccgaggacaccagcguguacuacugcgccagagagcugcugauggacuacuacgaccacaucggcuacagccccggccccaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35881 - RNA, 1371 nt, Artificial Sequence
  derived and/or modified sequence opt4 from anti-influenza_Chain
auggugauccagagaaacagcauccugcugcugaucaucaucuucgccagcagcaucagcaccugcagaagcaacgugaucgacgacaaccuguucaagcagguguacgacaacauccuggagcaggaguucgcccacgacuuccaggccuaccugagcuaccugagcaagaacaucgagagcaacaacaacaucgacaagguggacaagaacggcaucaaggugaucaacgugcugagcuucggcgccaagggcgacggcaagaccuacgacaacaucgccuucgagcaggccuggaacgaggccugcagcagcagaacccccgugcaguucguggugcccaagaacaagaacuaccugcugaagcagaucaccuucagcggccccugcagaagcagcaucagcgugaagaucuucggcagccuggaggccagcagcaagaucagcgacuacaaggacagaagacuguggaucgccuucgacagcgugcagaaccugguggugggcggcggcggcaccaucaacggcaacggccaggugugguggcccagcagcugcaagaucaacaagagccugcccugcagagacgcccccaccgcccugaccuucuggaacugcaagaaccugaaggugaacaaccugaagagcaagaacgcccagcagauccacaucaaguucgagagcugcaccaacgugguggccagcaaccugaugaucaacgccagcgccaagagccccaacaccgacggcgugcacgugagcaacacccaguacauccagaucagcgacaccaucaucggcaccggcgacgacugcaucagcaucgugagcggcagccagaacgugcaggccaccaacaucaccugcggccccggccacggcaucagcaucggcagccugggcagcggcaacagcgaggccuacgugagcaacgugaccgugaacgaggccaagaucaucggcgccgagaacggcgugagaaucaagaccuggcagggcggcagcggccaggccagcaacaucaaguuccugaacguggagaugcaggacgugaaguaccccaucaucaucgaccagaacuacugcgacagaguggagcccugcauccagcaguucagcgccgugcaggugaagaacgugguguacgagaacaucaagggcaccagcgccaccaagguggccaucaaguucgacugcagcaccaacuuccccugcgagggcaucaucauggagaacaucaaccuggugggcgagagcggcaagcccagcgaggccaccugcaagaacgugcacuucaacaacgccgagcacgugaccccccacugcaccagccuggagaucagcgaggacgaggcccugcuguacaacuac

SEQ ID NO: 35882 - RNA, 1371 nt, Artificial Sequence; identical to SEQ ID NO: 35881
  derived and/or modified sequence opt4 from anti-influenza_Chain

SEQ ID NO: 35883 - RNA, 1380 nt, Artificial Sequence
  derived and/or modified sequence opt4 from anti-influenza_Chain
augaagcuguggcugaacuggaucuuccuggugacccugcugaacgacauccagugcgaggugaagcugguggagagcggcggcggccuggugcagcccggcggcagccugagacugagcugcgccaccagcggcuucaccuucagcgacuacuacaugagcugggugagacagagccccggcaaggcccuggaguggcugggcuucaccagaagcagagugcugggcuacaccaccgacuacagcgccagcgugaagggcagauucaccaucagcagagacaacagccagagcauccuguaccugcagaugaacagccugagaggcgaggacagcgccaccuacuacugcgccagagacagacccauggacuacuggggccagggcaccagcgugaccgugagcagcgccaagaccaccccccccagcguguacccccuggcccccggcagcgccgcccagaccaacagcauggugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagcaccuggcccagcgagaccgugaccugcaacguggcccaccccgccagcagcaccaagguggacaagaagaucgugcccagagacugcggcugcaagcccugcaucugcaccgugcccgaggugagcagcguguucaucuucccccccaagcccaaggacgugcugaccaucacccugacccccaaggugaccugcguggugguggacaucagcaaggacgaccccgaggugcaguucagcugguucguggacgacguggaggugcacaccgcccagacccagcccagagaggagcaguucaacagcaccuucagaagcgugagcgagcugcccaucaugcaccaggacuggcugaacggcaaggaguucaagugcagagugaacagcgccgccuuccccgcccccaucgagaagaccaucagcaagaccaagggcagacccaaggccccccagguguacaccauccccccccccaaggagcagauggccaaggacaaggugagccugaccugcaugaucaccgacuucuuccccgaggacaucaccguggaguggcaguggaacggccagcccgccgagaacuacaagaacacccagcccaucauggacaccgacggcagcuacuucguguacagcaagcugaacgugcagaagagcaacugggaggccggcaacaccuucaccugcagcgugcugcacgagggccugcacaaccaccacaccgagaagagccugagccacagccccggcaag

SEQ ID NO: 35884 - RNA, 1380 nt, Artificial Sequence; identical to SEQ ID NO: 35883
  derived and/or modified sequence opt4 from anti-influenza_Chain

SEQ ID NO: 35885 - RNA, 1386 nt, Artificial Sequence
  derived and/or modified sequence opt4 from anti-influenza_Chain
auggaguggagcuggaucuuccuguuccugcugagcggcaccgccggcgugcacagcgaggugcagcugcagcagagcggccccgagcuggugaagcccggcgccagcgugaagaugagcugcaaggccagcggcuacaccuucaccagcuacgugaugcacugggugaagcagaagcccggccagggccuggaguggaucggcuacaucaaccccuacaacgacggcaccagauacaacgagaaguucagagugaaggccacccugaccagcgacaagagcagcagcaccgccuacauggagcugagcagccugaccagcgaggacagcgccguguacuacugcgccagaagaggccugaucaccacccccacccuggacuacuggggccagggcaccacccugaccgugagcagcgccaagaccaccccccccagcguguacccccuggcccccggcagcgccgcccagaccaacagcauggugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagcaccuggcccagcgagaccgugaccugcaacguggcccaccccgccagcagcaccaagguggacaagaagaucgugcccagagacugcggcugcaagcccugcaucugcaccgugcccgaggugagcagcguguucaucuucccccccaagcccaaggacgugcugaccaucacccugacccccaaggugaccugcguggugguggacaucagcaaggacgaccccgaggugcaguucagcuggguggacgacguggaggugcacaccgcccagacccagcccagagaggagcaguucaacagcaccuucagaagcgugagcgagcugcccaucaugcaccaggacuggcugaacggcaaggaguucaagugcagagugaacagcgccgccuuccccgcccccaucgagaagaccaucagcaagaccaagggcagacccaaggccccccagguguacaccauccccccccccaaggagcagauggccaaggacaaggugagccugaccugcaugaucaccgacuucuuccccgaggacaucaccguggaguggcaguggaacggccagcccgccgagaacuacaagaacacccagcccaucauggacaccgacggcagcuacuucguguacagcaagcugaacgugcagaagagcaacugggaggccggcaacaccuucaccugcagcgugcugcacgagggccugcacaaccaccacaccgagaagagccugagccacagccccggcaag

SEQ ID NO: 35886 - RNA, 1386 nt, Artificial Sequence
  derived and/or modified sequence opt4 from anti-influenza_Chain
caggugcagcuggugcagagcggcgccgaggugaagaagcccggcgccagcgugaaggugagcugcaagaccagcggcuacaccuucaccgccuacaccauccacugggugagacaggcccccggccagagacuggaguggaugggcuggaucaacgccggcaacggccacaccaaguacagccagagauucaagggcagagugaccaucaccagagacaccagcgccagaaccaccuacauggagcugagaagccugaccagcgaggacaccgcccuguacuucugcgccagaggccccgagaccuacuacuacgacaagaccaacuggcugaacagccaccccgacgaguacuuccagcacuggggccacggcacccaggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35887 - RNA, 1386 nt, Artificial Sequence; identical to SEQ ID NO: 35886
  derived and/or modified sequence opt4 from anti-influenza_Chain

SEQ ID NO: 35888 - RNA, 1386 nt, Artificial Sequence; identical to SEQ ID NO: 35885
  derived and/or modified sequence opt4 from anti-influenza_Chain

SEQ ID NO: 35889 - RNA, 1398 nt, Artificial Sequence
  derived and/or modified sequence opt4 from anti-influenza_Chain
augcugcccagcaccgugcagacccugacccugcugcugaccagcggcggcgugcugcugagccuguacgugagcgccagccugagcuaccugcuguacagcgacgugcugcugaaguucagcagcaccaagaccaccgcccccaccaugagccuggagugcaccaacgccagcaacgcccagaccgugaaccacagcgccaccaaggagaugaccuuccccccccccgagcccgaguggaccuaccccagacugagcugccagggcagcaccuuccagaaggcccugcugaucagcccccacagauucggcgagaucaagggcaacagcgccccccugaucaucagagagcccuucguggccugcggccccaaggagugcagacacuucgcccugacccacuacgccgcccagcccggcggcuacuacaacggcaccagaaaggacagaaacaagcugagacaccuggugagcgugaagcugggcaagauccccaccguggagaacagcaucuuccacauggccgccuggagcggcagcgccugccacgacggcagagaguggaccuacaucggcguggacggccccgacaacgacgcccuggugaagaucaaguacggcgaggccuacaccgacaccuaccacagcuacgcccacaacauccugagaacccaggagagcgccugcaacugcaucggcggcgacugcuaccugaugaucaccgacggcagcgccagcggcaucagcaagugcagauuccugaagaucagagagggcagaaucaucaaggagauccugcccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgacgacggcagcaucgccggccccugcgagagcaacggcgacaaguggcugggcggcaucaagggcggcuucgugcaccagagaauggccagcaagaucggcagaugguacagcagaaccaugagcaagaccaacagaaugggcauggagcuguacgugaaguacgacggcgaccccuggaccgacagcgacgcccugacccugagcggcgugauggugagcaucgaggagcccggcugguacagcuucggcuucgagaucaaggacaagaagugcgacgugcccugcaucggcaucgagauggugcacgacggcggcaaggacaccuggcacagcgccgccaccgccaucuacugccugaugggcagcggccagcugcugugggacaccgugaccggcguggacauggcccug

SEQ ID NO: 35890 - RNA, 1398 nt, Artificial Sequence; identical to SEQ ID NO: 35889
  derived and/or modified sequence opt4 from anti-influenza_Chain

SEQ ID NO: 35891 - RNA, 1407 nt, Artificial Sequence
  derived and/or modified sequence opt4 from anti-influenza_Chain
auggacuggaccuggagauuccuguucgugguggccgccgccaccggcgugcagagccaggugcagcuggugcagagcggcgccgaggugaagaagcccggcagcagcgugaaggugagcugcaaggccagcggcggcacccugaacaacuacgccaucagcugggugagacaggcccccggccagggccuggaguggaugggcggcaucagccccaucuucggcacccugaacuacgccgagagauuccagggcagagugaccaucaccgccgacguguucaccaacaccguguacauggagcugagcagccugagaagcgaggacaccgccguguacuucugcgccagaggcugcggcuacaacugcuacuacuucgacggcuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgagggccugcacaaccacuacacccagaagagccugagccugagccccggcaag

SEQ ID NO: 35892 - RNA, 1407 nt, Artificial Sequence; identical to SEQ ID NO: 35891
  derived and/or modified sequence opt4 from anti-influenza_Chain

SEQ ID NO: 35893 - RNA, 1407 nt, Artificial Sequence; identical to SEQ ID NO: 35891
  derived and/or modified sequence opt4 from anti-influenza_Chain

SEQ ID NO: 35894 - RNA, 1413 nt, Artificial Sequence
  derived and/or modified sequence opt4 from anti-influenza_Chain
gacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcuacauccccgaggcccccagagacggccaggccuacgugagaaaggacggcgagugggugcugcugagcaccuuccugagaagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35895 - RNA, 1413 nt, Artificial Sequence; identical to SEQ ID NO: 35894
  derived and/or modified sequence opt4 from anti-influenza_Chain

SEQ ID NO: 35896 - RNA, 1416 nt, Artificial Sequence
  derived and/or modified sequence opt4 from anti-influenza_Chain
auggacuggaccuggagauuccuguucgugguggccgccgccaccggcgugcagugccaggugcagcuggugcagagcggcgccgaggugaagaugcccggcagcagcgugaaggugagcugcaagaccagcggcguguucuucagcagccacgccaucagcugggugagacaggcccccggccagggccuggaguggaugggcggcaucagccccauguucggcaccacccacuacgcccagaaguuccagggcagagugaccaucaccgccgaccagagcaccaccaccgccuacauggagcugaccagccugaccagcgaggacaccgccguguacuacugcgccagagacggcgccggcagcuacuacccccugaacugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgagggccugcacaaccacuacacccagaagagccugagccugagccccggcaag

SEQ ID NO: 35897 - RNA, 1416 nt, Artificial Sequence; identical to SEQ ID NO: 35896
  derived and/or modified sequence opt4 from anti-influenza_Chain

SEQ ID NO: 35898 - RNA, 1416 nt, Artificial Sequence; identical to SEQ ID NO: 35896
  derived and/or modified sequence opt4 from anti-influenza_Chain

SEQ ID NO: 35899 - RNA, 1419 nt, Artificial Sequence
  derived and/or modified sequence opt4 from anti-influenza_Chain
augaccgagagcgccaugaccagcagagccggcagaggcagaggcgccgaccugguggccgccguggugcagggccacgccgccgccagcgacgccgccggcgaccugagcuuccccgacggcuucaucuggggcgccgccaccgccgccuaccagaucgagggcgccuggagagaggacggcagaggccugugggacguguucagccacacccccggcaagguggccagcggccacaccggcgacaucgccugcgaccacuaccacagauacgccgacgacgugagacugauggccggccugggcgacagaguguacagauucagcguggccuggcccagaaucgugcccgacggcagcggccccgugaaccccgccggccuggacuucuacgacagacugguggacgagcugcugggccacggcaucacccccuaccccacccuguaccacugggaccugccccagacccuggaggacagaggcggcugggccgccagagacaccgccuacagauucgccgaguacgcccuggccgugcacagaagacugggcgacagagugagaugcuggaucacccugaacgagcccuggguggccgccuuccuggccacccacagaggcgcccccggcgccgccgacgugcccagauucagagccgugcaccaccugcugcugggccacggccugggccugagacugagaagcgccggcgccggccagcugggccugacccugagccugagccccgugaucgaggccagacccggcgugagaggcggcggcagaagaguggacgcccuggccaacagacaguuccuggaccccgcccugagaggcagauaccccgaggaggugcugaagaucauggccggccacgccagacugggccaccccggcagagaccuggagaccauccaccagcccguggaccugcugggcgugaacuacuacagccacgugagacuggccgccgagggcgagcccgccaacagacugcccggcagcgagggcaucagauucgagagacccaccgccgugaccgccuggcccggcgacagacccgacggccugagaacccugcugcugagacugagcagagacuaccccggcgugggccugaucaucaccgagaacggcgccgccuucgacgacagagccgacggcgacagagugcacgaccccgagagaaucagauaccugaccgccacccugagagccgugcacgacgccaucauggccggcgccgaccugagaggcuacuucguguggagcgugcuggacaacuucgagugggccuacggcuaccacaagagaggcaucguguacguggacuacaccaccaugagaagaauccccagagagagcgcccugugguacagagacguggugagaagaaacggccugagaaacggcgag

SEQ ID NO: 35900 - RNA, 1419 nt, Artificial Sequence; identical to SEQ ID NO: 35899
  derived and/or modified sequence opt4 from anti-influenza_Chain

SEQ ID NO: 35901 - RNA, 1422 nt, Artificial Sequence
  derived and/or modified sequence opt4 from anti-influenza_Chain
cugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcgacagcgccaucgugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugggcuacauccccgaggcccccagagacggccaggccuacgugagaaaggacggcgagugggugcugcugagcaccuuccugagaagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35902 - RNA, 1422 nt, Artificial Sequence; identical to SEQ ID NO: 35901
  derived and/or modified sequence opt4 from anti-influenza_Chain

SEQ ID NO: 35903 - RNA, 1428 nt, Artificial Sequence
  derived and/or modified sequence opt4 from anti-influenza_Chain
auggaguucggccugagcuggguguuccugguggcccugcugagaggcgugcagugccaggugcagcugguggagagcggcggcggcguggugcagcccggcagaagccugagacugagcugcgccgccagcggcuucaccuucagcagauucggcauccacugggugagacaggcccccggcaagggccuggaguggauggccgugaucugguacgacggcagcaacaaguucuacgccgacagcgugaagggcagauucaccaucagcagagacaacagcaagaacaccguguaccugcagaugaacagccugagagccgaggacaccgccguguacuacugcgccaaggacagcagaggcuacugcagcagcaucaucugcuucgagggcggccuggacaacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgagggccugcacaaccacuacacccagaagagccugagccugagccccggcaag

SEQ ID NO: 35904 - RNA, 1428 nt, Artificial Sequence; identical to SEQ ID NO: 35903
  derived and/or modified sequence opt4 from anti-influenza_Chain

SEQ ID NO: 35905 - RNA, 1428 nt, Artificial Sequence; identical to SEQ ID NO: 35903
  derived and/or modified sequence opt4 from anti-influenza_Chain

SEQ ID NO: 35906 - RNA, 1440 nt, Artificial Sequence
  derived and/or modified sequence opt4 from anti-influenza_Chain
augcccagcgugaagaucggcaucaucggcgccggcagcgccguguucagccugagacuggugagcgaccugugcaagacccccggccugagcggcagcaccgugacccugauggacaucgacgaggagagacuggacgccauccugaccaucgccaagaaguacguggaggaggugggcgccgaccugaaguucgagaagaccaugaaccuggacgacgugaucaucgacgccgacuucgugaucaacaccgccauggugggcggccacaccuaccuggagaaggugagacagaucggcgagaaguacggcuacuacagaggcaucgacgcccaggaguucaacauggugagcgacuacuacaccuucagcaacuacaaccagcugaaguacuucguggacaucgccagaaagaucgagaagcugagccccaaggccugguaccugcaggccgccaaccccaucuucgagggcaccacccuggugaccagaaccgugcccaucaaggccgugggcuucugccacggccacuacggcgugauggagaucguggagaagcugggccuggaggaggagaagguggacuggcagguggccggcgugaaccacggcaucuggcugaacagauucagauacaacggcggcaacgccuacccccugcuggacaaguggaucgaggagaagagcaaggacuggaagcccgagaaccccuucaacgaccagcugagccccgccgccaucgacauguacagauucuacggcgugaugcccaucggcgacaccgugagaaacagcagcuggagauaccacagagaccuggagaccaagaagaagugguacggcgagcccuggggcggcgccgacagcgagaucggcuggaagugguaccaggacacccugggcaaggugaccgagaucaccaagaagguggccaaguucaucaaggagaaccccagcgugagacugagcgaccugggcagcgugcugggcaaggaccugagcgagaagcaguucgugcuggagguggagaagauccuggaccccgagagaaagagcggcgagcagcacauccccuucaucgacgcccugcugaacgacaacaaggccagauucguggugaacauccccaacaagggcaucauccacggcaucgacgacgacguggugguggaggugcccgcccugguggacaagaacggcauccaccccgagaagaucgagcccccccugcccgacagaguggugaaguacuaccugagacccagaaucaugagaauggagauggcccuggaggccuuccugaccggcgacaucagaaucaucaaggagcugcuguacagagaccccagaaccaagagcgacgagcagguggagaaggugaucgaggagauccuggcccugcccgagaacgaggagaugagaaagcacuaccugaagaga

SEQ ID NO: 35907 - RNA, 1440 nt, Artificial Sequence; identical to SEQ ID NO: 35906
  derived and/or modified sequence opt4 from anti-influenza_Chain

SEQ ID NO: 35908 - RNA, 1443 nt, Artificial Sequence
  derived and/or modified sequence opt4 from anti-influenza_Chain
augaaguuccccaaggacuucaugaucggcuacagcagcagccccuuccaguucgaggccggcauccccggcagcgaggaccccaacagcgacuggugggugugggugcacgaccccgagaacaccgccgccggccuggugagcggcgacuuccccgagaacggccccggcuacuggaaccugaaccagaacgaccacgaccuggccgagaagcugggcgugaacaccaucagagugggcguggaguggagcagaaucuuccccaagcccaccuucaacgugaaggugcccguggagagagacgagaacggcagcaucgugcacguggacguggacgacaaggccguggagagacuggacgagcuggccaacaaggaggccgugaaccacuacguggagauguacaaggacuggguggagagaggcagaaagcugauccugaaccuguaccacuggccccugccccuguggcugcacaaccccaucauggugagaagaaugggccccgacagagcccccagcggcuggcugaacgaggagagcgugguggaguucgccaaguacgccgccuacaucgccuggaagaugggcgagcugcccgugauguggagcaccaugaacgagcccaacgugguguacgagcagggcuacauguucgugaagggcggcuucccccccggcuaccugagccuggaggccgccgacaaggccagaagaaacaugauccaggcccacgccagagccuacgacaacaucaagagauucagcaagaagcccgugggccugaucuacgccuuccagugguucgagcugcuggagggccccgccgagguguucgacaaguucaagagcagcaagcuguacuacuucaccgacaucgugagcaagggcagcagcaucaucaacguggaguacagaagagaccuggccaacagacuggacuggcugggcgugaacuacuacagcagacugguguacaagaucguggacgacaagcccaucauccugcacggcuacggcuuccugugcacccccggcggcaucagccccgccgagaaccccugcagcgacuucggcugggagguguaccccgagggccuguaccugcugcugaaggagcuguacaacagauacggcguggaccugaucgugaccgagaacggcgugagcgacagcagagacgcccugagacccgccuaccuggugagccacguguacagcguguggaaggccgccaacgagggcauccccgugaagggcuaccugcacuggagccugaccgacaacuacgagugggcccagggcuucagacagaaguucggccuggugaugguggacuucaagaccaagaagagauaccugagacccagcgcccugguguucagagagaucgccacccacaacggcauccccgacgagcugcagcaccugacccugauccag

SEQ ID NO: 35909 - RNA, 1443 nt, Artificial Sequence; identical to SEQ ID NO: 35908
  derived and/or modified sequence opt4 from anti-influenza_Chain

SEQ ID NO: 35910 - RNA, 1464 nt, Artificial Sequence
  derived and/or modified sequence opt4 from anti-influenza_Chain
cacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcuacauccccgaggcccccagagacggccaggccuacgugagaaaggacggcgagugggugcugcugagcaccuuccugagaagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35911 - RNA, 1464 nt, Artificial Sequence; identical to SEQ ID NO: 35910
  derived and/or modified sequence opt4 from anti-influenza_Chain

SEQ ID NO: 35912 - RNA, 1473 nt, Artificial Sequence
  derived and/or modified sequence opt4 from anti-influenza_Chain
augcugagcuuccccaagggcuucaaguucggcuggagccagagcggcuuccagagcgagaugggcacccccggcagcgaggaccccaacagcgacuggcacgugugggugcacgacagagagaacaucgugagccagguggugagcggcgaccugcccgagaacggccccggcuacuggggcaacuacaagagauuccacgacgaggccgagaagaucggccugaacgccgugagaaucaacguggaguggagcagaaucuuccccagaccccugcccaagcccgagaugcagaccggcaccgacaaggagaacagccccgugaucagcguggaccugaacgagagcaagcugagagagauggacaacuacgccaaccacgaggcccugagccacuacagacagauccuggaggaccugagaaacagaggcuuccacaucgugcugaacauguaccacuggacccugcccaucuggcugcacgaccccaucagagugagaagaggcgacuucaccggccccaccggcuggcugaacagcagaaccguguacgaguucgccagauucagcgccuacguggccuggaagcuggacgaccuggccagcgaguacgccaccaugaacgagcccaacgugguguggggcgccggcuacgccuuccccagagccggcuucccccccaacuaccugagcuucagacugagcgagaucgccaaguggaacaucauccaggcccacgccagagccuacgacgccaucaagagcgugagcaagaagagcgugggcaucaucuacgccaacaccagcuacuacccccugagaccccaggacaacgaggccguggagaucgccgagagacugaacagauggagcuucuucgacagcaucaucaagggcgagaucaccagcgagggccagaacgugagagaggaccugagaaacagacuggacuggaucggcgugaacuacuacaccagaaccguggugaccaaggccgagagcggcuaccugacccugcccggcuacggcgacagaugcgagagaaacagccugagccuggccaaccugcccaccagcgacuucggcugggaguucuuccccgagggccuguacgacgugcugcugaaguacuggaacagauacggccugccccuguacgugauggagaacggcaucgccgacgacgccgacuaccagagacccuacuaccuggugagccacaucuaccaggugcacagagcccugaacgagggcguggacgugagaggcuaccugcacuggagccuggccgacaacuacgaguggagcagcggcuucagcaugagauucggccugcugaagguggacuaccugaccaagagacuguacuggagacccagcgcccugguguacagagagaucaccagaagcaacggcauccccgaggagcuggagcaccugaacagagugccccccaucaagccccugagacac

SEQ ID NO: 35913 - RNA, 1473 nt, Artificial Sequence; identical to SEQ ID NO: 35912
  derived and/or modified sequence opt4 from anti-influenza_Chain

SEQ ID NO: 35914 - RNA, 1494 nt, Artificial Sequence
  derived and/or modified sequence opt4 from anti-influenza_Chain
auggccagccagggcaccaagagaagcuacgagcagauggagaccgacggcgagagacagaacgccaccgagaucagagccagcgugggcaagaugaucggcggcaucggcagauucuacauccagaugugcaccgagcugaagcugagcgacuacgagggcagacugauccagaacagccugaccaucgagagaauggugcugagcgccuucgacgagagaagaaacaaguaccuggaggagcaccccagcgccggcaaggaccccaagaagaccggcggccccaucuacagaagagugaacggcaaguggaugagagagcugauccuguacgacaaggaggagaucagaagaaucuggagacaggccaacaacggcgacgacgccaccgccggccugacccacaugaugaucuggcacagcaaccugaacgacgccaccuaccagagaaccagagcccuggugagaaccggcauggaccccagaaugugcagccugaugcagggcagcacccugcccagaagaagcggcgccgccggcgccgccgugaagggcgugggcaccauggugauggagcuggugagaaugaucaagagaggcaucaacgacagaaacuucuggagaggcgagaacggcagaaagaccagaaucgccuacgagagaaugugcaacauccugaagggcaaguuccagaccgccgcccagaaggccaugauggaccaggugagagagagcagagaccccggcaacgccgaguucgaggaccugaccuuccuggccagaagcgcccugauccugagaggcagcguggcccacaagagcugccugcccgccugcguguacggccccgccguggccagcggcuacgacuucgagagagagggcuacagccuggugggcaucgaccccuucagacugcugcagaacagccagguguacagccugaucagacccaacgagaaccccgcccacaagagccagcugguguggauggccugccacagcgccgccuucgaggaccugagagugcugagcuucaucaagggcaccaagguggugcccagaggcaagcugagcaccagaggcgugcagaucgccagcaacgagaacauggagaccauggagagcagcacccuggagcugagaagcagauacugggccaucagaaccagaagcggcggcaacaccaaccagcagagagccagcgccggccagaucagcauccagcccaccuucagcgugcagagaaaccugcccuucgacagaaccaccgugauggccgccuucaccggcaacaccgagggcagaaccagcgacaugagaaccgagaucaucagaaugauggagagcgccagacccgaggacgugagcuuccagggcagaggcguguucgagcugagcgacgagaaggccgccagccccaucgugcccagcuucgacaugagcaacgagggcagcuacuucuucggcgacaacgccgaggaguacgacaac

SEQ ID NO: 35915 - RNA, 1494 nt, Artificial Sequence
  derived and/or modified sequence opt4 from anti-influenza_Chain
auggccagccagggcaccaagagaagcuacgagcagauggagaccgacggcgagagacagaacgccaccgagaucagagccagcgugggcaagaugaucgacggcaucggcagauucuacauccagaugugcaccgagcugaagcugagcgacuacgagggcagacugauccagaacagccugaccaucgagagaauggugcugagcgccuucgacgagagaagaaacaaguaccuggaggagcaccccagcgccggcaaggaccccaagaagaccggcggccccaucuacaagagaguggacggcaaguggaugagagagcuggugcuguacgacaaggaggagaucagaagaaucuggagacaggccaacaacggcgacgacgccaccgccggccugacccacaugaugaucuggcacagcaaccugaacgacaccaccuaccagagaaccagagcccuggugagaaccggcauggaccccagaaugugcagccugaugcagggcagcacccugcccagaagaagcggcgccgccggcgccgccgugaagggcgugggcaccauggugauggagcugaucagaaugaucaagagaggcaucaacgacagaaacuucuggagaggcgagaacggcagaaagaccagaagcgccuacgagagaaugugcaacauccugaagggcaaguuccagaccgccgcccagagagccaugauggaccaggugagagagagcagaaaccccggcaacgccgagaucgaggaccugaucuuccuggccagaagcgcccugauccugagaggcagcguggcccacaagagcugccugcccgccugcguguacggccccgccaucgccagcggcuacaacuucgagaaggagggcuacagccuggugggcaucgaccccuucaagcugcugcagaacagccagguguacagccugaucagacccaacgagaaccccgcccacaagagccagcugguguggauggccugcaacagcgccgccuucgaggaccugagagugcugagcuucaucagaggcaccaaggugagccccagaggcaagcugagcaccagaggcgugcagaucgccagcaacgagaacauggacaccauggagagcagcacccuggagcugagaagcagauacugggccaucagaaccagaagcggcggcaacaccaaccagcagagagccagcgccggccagaucagcgugcagcccgccuucagcgugcagagaaaccugcccuucgacaagcccaccaucauggccgccuucaccggcaacaccgagggcagaaccagcgacaugagagccgagaucaucagaaugauggagggcgccaagcccgaggagaugagcuuccagggcagaggcguguucgagcugagcgacgagaaggccaccaaccccaucgugcccagcuucgacaugagcaacgagggcagcuacuucuucggcgacaacgccgaggaguacgacaac

SEQ ID NO: 35916 - RNA, 1494 nt, Artificial Sequence
  derived and/or modified sequence opt4 from anti-influenza_Chain
auggccagccagggcaccaagagaagcuacgagcagauggagaccggcggcgagagacagaacgccaccgagaucagagccagcgugggcagaauggugggcggcaucggcagauucuacgugcagaugugcaccgagcugaagcugagcgaccaggagggcagacugauccagaacagcaucaccaucgagagaauggugcugagcgccuucgacgagagaagaaacagauaccuggaggagcaccccagcgccggcaaggaccccaagaagaccggcggccccaucuacagaagaagagacggcaagugggugagagagcugauccuguacgacaaggaggagaucagaagaaucuggagacaggccaacaacggcgaggacgccaccgccggccugacccacaugaugaucuggcacagcaaccugaacgacgccaccuaccagagaaccagagcccuggugagaaccggcauggaccccagaaugugcagccugaugcagggcagcacccugcccagaagaagcggcgccgccggcgccgccaucaagggcgugggcaccauggugauggagcugaucagaaugaucaagagaggcaucaacgacagaaacuucuggagaggcgacaacggcagaagaaccagaaucgccuacgagagaaugugcaacauccugaagggcaaguuccagaccgccgcccagagagccaugauggaccaggugagagagagcagaaaccccggcaacgccgagaucgaggaccugaucuuccuggccagaagcgcccugauccugagaggcagcguggcccacaagagcugccugcccgccugcguguacggccuggccguggccagcggcuacgacuucgagagagagggcuacagccuggugggcaucgaccccuucagacugcugcagaacagccagguguucagccugaucagacccaacgagaaccccgcccacaagagccagcugguguggauggccugccacagcgccgccuucgaggaccugagagugagcagcuucaucagaggcaccagagugauccccagaggccagcugagcaccagaggcgugcagaucgccagcaacgagaacguggaggccauggacagcagcacccuggagcugagaagcagauacugggccaucagaaccagaagcggcggcaacaccaaccagcagagagccagcgccggccagaucagcgugcagcccaccuucagcgugcagagaaaccugcccuucgagagacccaccaucauggccgccuucaagggcaacaccgagggcagaaccagcgacaugagaaccgagaucaucagaaugauggagagcgccagacccgaggacgugagcuuccagggcagaggcguguucgagcugagcgacgagaaggccaccaaccccaucgugcccagcuucgacaugagcaacgagggcagcuacuucuucggcgacaacgccgaggaguacgacaac

SEQ ID NO: 35917 - RNA, 1494 nt, Artificial Sequence; identical to SEQ ID NO: 35914
  derived and/or modified sequence opt4 from anti-influenza_Chain

SEQ ID NO: 35918 - RNA, 1494 nt, Artificial Sequence; identical to SEQ ID NO: 35915
  derived and/or modified sequence opt4 from anti-influenza_Chain

SEQ ID NO: 35919 - RNA, 1494 nt, Artificial Sequence; identical to SEQ ID NO: 35916
  derived and/or modified sequence opt4 from anti-influenza_Chain

SEQ ID NO: 35920 - RNA, 1530 nt, Artificial Sequence
  derived and/or modified sequence opt4 from anti-influenza_Chain
auguuccccgagaaguuccuguggggcguggcccagagcggcuuccaguucgagaugggcgacaagcugagaagaaacaucgacaccaacaccgacugguggcacugggugagagacaagaccaacaucgagaagggccuggugagcggcgaccugcccgaggagggcaucaacaacuacgagcuguacgagaaggaccacgagaucgccagaaagcugggccugaacgccuacagaaucggcaucgaguggagcagaaucuuccccuggcccaccaccuucaucgacguggacuacagcuacaacgagagcuacaaccugaucgaggacgugaagaucaccaaggacacccuggaggagcuggacgagaucgccaacaagagagagguggccuacuacagaagcgugaucaacagccugagaagcaagggcuucaaggugaucgugaaccugaaccacuucacccugcccuacuggcugcacgaccccaucgaggccagagagagagcccugaccaacaagagaaacggcugggugaaccccagaaccgugaucgaguucgccaaguacgccgccuacaucgccuacaaguucggcgacaucguggacauguggagcaccuucaacgagcccaugguggugguggagcugggcuaccuggcccccuacagcggcuucccccccggcgugcugaaccccgaggccgccaagcuggccauccugcacaugaucaacgcccacgcccuggccuacagacagaucaagaaguucgacaccgagaaggccgacaaggacagcaaggagcccgccgaggugggcaucaucuacaacaacaucggcguggccuaccccaaggaccccaacgacagcaaggacgugaaggccgccgagaacgacaacuucuuccacagcggccuguucuucgaggccauccacaagggcaagcugaacaucgaguucgacggcgagaccuucaucgacgcccccuaccugaagggcaacgacuggaucggcgugaacuacuacaccagagagguggugaccuaccaggagcccauguuccccagcaucccccugaucaccuucaagggcgugcagggcuacggcuacgccugcagacccggcacccugagcaaggacgacagacccgugagcgacaucggcugggagcuguaccccgagggcauguacgacagcaucguggaggcccacaaguacggcgugcccguguacgugaccgagaacggcaucgccgacagcaaggacauccugagacccuacuacaucgccagccacaucaagaugaccgagaaggccuucgaggacggcuacgaggugaagggcuacuuccacugggcccugaccgacaacuucgagugggcccugggcuucagaaugagauucggccuguacgaggugaaccugaucaccaaggagagaauccccagagagaagagcgugagcaucuucagagagaucguggccaacaacggcgugaccaagaagaucgaggaggagcugcugagaggc

SEQ ID NO: 35921 - RNA, 1530 nt, Artificial Sequence; identical to SEQ ID NO: 35920
  derived and/or modified sequence opt4 from anti-influenza_Chain

SEQ ID NO: 35922 - RNA, 1536 nt, Artificial Sequence
  derived and/or modified sequence opt4 from anti-influenza_Chain
augaagagaaaggugaagaagauggccgccauggccaccagcaucaucauggccaucaugaucauccugcacagcauccccgugcuggccggcagaaucaucuacgacaacgagaccggcacccacggcggcuacgacuacgagcuguggaaggacuacggcaacaccaucauggagcugaacgacggcggcaccuucagcugccaguggagcaacaucggcaacgcccuguucagaaagggcagaaaguucaacagcgacaagaccuaccaggagcugggcgacaucgugguggaguacggcugcgacuacaaccccaacggcaacagcuaccugugcguguacggcuggaccagaaacccccugguggaguacuacaucguggagagcuggggcagcuggagaccccccggcgccacccccaagggcaccaucacccaguggauggccggcaccuacgagaucuacgagaccaccagagugaaccagcccagcaucgacggcaccgccaccuuccagcaguacuggagcgugagaaccagcaagagaaccagcggcaccaucagcgugaccgagcacuucaagcagugggagagaaugggcaugagaaugggcaagauguacgagguggcccugaccguggagggcuaccagagcagcggcuacgccaacguguacaagaacgagaucagaaucggcgccaaccccacccccgcccccagccagagccccaucagaagagacgccuucagcaucaucgaggccgaggaguacaacagcaccaacagcagcacccugcaggugaucggcacccccaacaacggcagaggcaucggcuacaucgagaacggcaacaccgugaccuacagcaacaucgacuucggcagcggcgccaccggcuucagcgccaccguggccaccgaggugaacaccagcauccagaucagaagcgacagccccaccggcacccugcugggcacccuguacgugagcagcaccggcagcuggaacaccuaccagaccgugagcaccaacaucagcaagaucaccggcgugcacgacaucgugcugguguucagcggccccgugaacguggacaacuucaucuucagcagaagcagccccgugcccgcccccggcgacaacaccagagacgccuacagcaucauccaggccgaggacuacgacagcagcuacggccccaaccugcagaucuucagccugcccggcggcggcagcgccaucggcuacaucgagaacggcuacagcaccaccuacaagaacaucgacuucggcgacggcgccaccagcgugaccgccagaguggccacccagaacgccaccaccauccaggugagacugggcagccccagcggcacccugcugggcaccaucuacgugggcagcaccggcagcuucgacaccuacagagacgugagcgccaccaucagcaacaccgccggcgugaaggacaucgugcugguguucagcggccccgugaacguggacugguucguguucagcaagagcggcacc

SEQ ID NO: 35923 - RNA, 1536 nt, Artificial Sequence; identical to SEQ ID NO: 35922
  derived and/or modified sequence opt4 from anti-influenza_Chain

SEQ ID NO: 35924 - RNA, 1539 nt, Artificial Sequence
  derived and/or modified sequence opt4 from anti-influenza_Chain
aucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcuacauccccgaggcccccagagacggccaggccuacgugagaaaggacggcgagugggugcugcugagcaccuuccugagaagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35925 - RNA, 1539 nt, Artificial Sequence; identical to SEQ ID NO: 35924
  derived and/or modified sequence opt4 from anti-influenza_Chain

SEQ ID NO: 35926 - RNA, 1593 nt, Artificial Sequence
  derived and/or modified sequence opt4 from anti-influenza_Chain
acccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgcc

SEQ ID NO: 35927 - RNA, 1593 nt, Artificial Sequence
  derived and/or modified sequence opt4 from anti-influenza_Chain
acccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcugcaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgcc

SEQ ID NO: 35928 - RNA, 1593 nt, Artificial Sequence
  derived and/or modified sequence opt4 from anti-influenza_Chain
acccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaacaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgcc

SEQ ID NO: 35929 - RNA, 1593 nt, Artificial Sequence
  derived and/or modified sequence opt4 from anti-influenza_Chain
acccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucggccccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgcc

SEQ ID NO: 35930 - RNA, 1593 nt, Artificial Sequence; identical to SEQ ID NO: 35926
  derived and/or modified sequence opt4 from anti-influenza_Chain

SEQ ID NO: 35931 - RNA, 1593 nt, Artificial Sequence; identical to SEQ ID NO: 35927
  derived and/or modified sequence opt4 from anti-influenza_Chain

SEQ ID NO: 35932 - RNA, 1593 nt, Artificial Sequence; identical to SEQ ID NO: 35928
  derived and/or modified sequence opt4 from anti-influenza_Chain

SEQ ID NO: 35933 - RNA, 1593 nt, Artificial Sequence; identical to SEQ ID NO: 35929
  derived and/or modified sequence opt4 from anti-influenza_Chain

SEQ ID NO: 35934 - RNA, 1605 nt, Artificial Sequence
  derived and/or modified sequence opt4 from anti-influenza_Chain
gccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgcc

SEQ ID NO: 35935 - RNA, 1605 nt, Artificial Sequence
  derived and/or modified sequence opt4 from anti-influenza_Chain
gccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccagagccggcgccaagggcuucuacaagaaccugaucuggcuggugaagaagggcaacagcuaccccaagcugaacaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgagaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccguggacaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgcc

SEQ ID NO: 35936 - RNA, 1605 nt, Artificial Sequence; identical to SEQ ID NO: 35934
  derived and/or modified sequence opt4 from anti-influenza_Chain

SEQ ID NO: 35937 - RNA, 1605 nt, Artificial Sequence; identical to SEQ ID NO: 35935
  derived and/or modified sequence opt4 from anti-influenza_Chain

SEQ ID NO: 35938 - RNA, 1644 nt, Artificial Sequence
  derived and/or modified sequence opt4 from anti-influenza_Chain
cagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacauc

SEQ ID NO: 35939 - RNA, 1644 nt, Artificial Sequence; identical to SEQ ID NO: 35938
  derived and/or modified sequence opt4 from anti-influenza_Chain

SEQ ID NO: 35940 - RNA, 1647 nt, Artificial Sequence
  derived and/or modified sequence opt4 from anti-influenza_Chain
augcugaccuuccacagaaucaucagaaagggcuggauguuccugcuggccuuccugcugaccgcccugcuguucugccccaccggccagcccgccaaggccgccgcccccuucaacggcaccaugaugcaguacuucgagugguaccugcccgacgacggcacccuguggaccaagguggccaacgaggccaacaaccugagcagccugggcaucaccgcccuguggcugccccccgccuacaagggcaccagcagaagcgacgugggcuacggcguguacgaccuguacgaccugggcgaguucaaccagaagggcgccgugagaaccaaguacggcaccaaggcccaguaccugcaggccauccaggccgcccacgccgccggcaugcagguguacgccgacgugguguucgaccacaagggcggcgccgacggcaccgaguggguggacgccguggaggugaaccccagcgacagaaaccaggagaucagcggcaccuaccagauccaggccuggaccaaguucgacuuccccggcagaggcaacaccuacagcagcuucaaguggagaugguaccacuucgacggcguggacugggacgagagcagaaagcugagcagaaucuacaaguucagaggcaucggcaaggccugggacugggagguggacaccgagaacggcaacuacgacuaccugauguacgccgaccuggacauggaccaccccgagguggugaccgagcugaagagcuggggcaagugguacgugaacaccaccaacaucgacggcuucagacuggacgccgugaagcacaucaaguucagcuucuuccccgacuggcugagcgacgugagaagccagaccggcaagccccuguucaccgugggcgaguacuggagcuacgacaucaacaagcugcacaacuacaucaugaagaccaacggcaccaugagccuguucgacgccccccugcacaacaaguucuacaccgccagcaagagcggcggcaccuucgacaugagaacccugaugaccaacacccugaugaaggaccagcccacccuggccgugaccuucguggacaaccacgacaccgagcccggccaggcccugcagagcuggguggaccccugguucaagccccuggccuacgccuucauccugaccagacaggagggcuaccccugcguguucuacggcgacuacuacggcaucccccaguacaacauccccagccugaagagcaagaucgacccccugcugaucgccagaagagacuacgccuacggcacccagcacgacuaccuggaccacagcgacaucaucggcuggaccagagagggcgugaccgagaagcccggcagcggccuggccgcccugaucaccgacggccccggcggcagcaaguggauguacgugggcaagcagcacgccggcaagguguucuacgaccugaccggcaacagaagcgacaccgugaccaucaacagcgacggcuggggcgaguucaaggugaacggcggcagcgugagcgugugggugcccagaaagaccaccgugagcaccaucgccuggagcaucaccaccagacccuggaccgacgaguucgugagauggaccgagcccagacugguggccuggccc

SEQ ID NO: 35941 - RNA, 1647 nt, Artificial Sequence
  derived and/or modified sequence opt4 from anti-influenza_Chain
aucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcgacagcgccaucgugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagaagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 35942 - RNA, 1647 nt, Artificial Sequence; identical to SEQ ID NO: 35941
  derived and/or modified sequence opt4 from anti-influenza_Chain

SEQ ID NO: 35943 - RNA, 1647 nt, Artificial Sequence; identical to SEQ ID NO: 35940
  derived and/or modified sequence opt4 from anti-influenza_Chain

SEQ ID NO: 35944 - RNA, 1650 nt, Artificial Sequence
  derived and/or modified sequence opt4 from anti-influenza_Chain
gaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucugggccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcauc

SEQ ID NO: 35945 - RNA, 1650 nt, Artificial Sequence; identical to SEQ ID NO: 35944
  derived and/or modified sequence opt4 from anti-influenza_Chain

SEQ ID NO: 35946 - RNA, 1656 nt, Artificial Sequence
  derived and/or modified sequence opt4 from anti-influenza_Chain
augaacauccagauccuggccuucaucgccugcgugcugaccggcgccaagggcgacaagaucugccugggccaccacgccguggccaacggcaccaaggugaacacccugaccgagaagggcaucgagguggugaacgccaccgagaccguggagaccgccgacgugaagaagaucugcacccagggcaagagagccaccgaccugggcagaugcggccugcugggcacccugaucggccccccccagugcgaccaguuccuggaguucagcagcgaccugaucaucgagagaagagagggcaccgacgugugcuaccccggcagauucaccaacgaggagagccugagacagauccugagaagaagcggcggcaucggcaaggagagcaugggcuucaccuacagcggcaucagaaccaacggcgccgccagcgccugcaccagaagcggcagcagcuucuacgccgagaugaaguggcugcugagcaacagcgacaacagcgccuucccccagaugaccaaggccuacagaaaccccagaaacaagcccgcccugaucaucuggggcgugcaccacagcgagagcgccagcgagcagaccaagcuguacggcagcggcaacaagcugaucaccgugagaagcagcaaguaccagcagagcuucacccccagccccggcaccagaagaaucgacuuccacuggcugcugcuggaccccaacgacaccgugaccuucaccuucaacggcgccuucaucgcccccgacagagccagcuucuucagaggcgagagccugggcgugcagagcgacgccccccuggacagcagcugcagaggcgacugcuuccacagcggcggcaccaucgugagcagccugcccuuccagaacaucaacagcagaaccgugggcagaugccccagauacgugaagcagaagagccugcugcuggccaccggcaugagaaacgugcccgagaagcccaagcccagaggccuguucggcgccaucgccggcuucaucgagaacggcugggagggccugaucaacggcugguacggcuucagacaccagaacgcccagggcgagggcaccgccgccgacuacaagagcacccagagcgccaucgaccagaucaccggcaagcugaacagacugaucggcaagaccaaccagcaguucgagcugaucgacaacgaguucaacgagaucgagcagcagaucggcaacgugaucaacuggaccagagacgccaugaccgagaucuggagcuacaacgccgagcugcugguggccauggagaaccagcacaccaucgaccuggccgacagcgagaugagcaagcuguacgagagagugaagaagcagcugagagagaacgccgaggaggacggcaccggcugcuucgagaucuuccacaagugcgacgaccagugcauggagagcaucagaaacaacaccuacgaccacacccaguacagaaccgagagccugcagaacagaauccagaucgaccccgugaagcugagcagcggcuacaaggacaucauccugugguucagcuucggcgccagcugcuucauccugcuggccaucgccaugggccugguguucaucugcaucaagaacggcaacaugcagugcaccaucugcauc

SEQ ID NO: 35947 - RNA, 1656 nt, Artificial Sequence
  derived and/or modified sequence opt4 from anti-influenza_Chain
augaacacccagauccuggccuucaucgccugcgugcugaccggcgugaagggcgacaagaucugccugggccaccacgccguggccaacggcaccaaggugaacacccugaccgagaagggcaucgagguggugaacgccaccgagaccguggagaccgccgacgugaagaagaucugcacccagggcaagagagccaccgaccugggcagaugcggccugcugggcacccugaucggccccccccagugcgaccaguuccuggaguucagcagcgaccugaucaucgagagaagagagggcaccgacgugugcuaccccggcagauucaccaacgaggagagccugagacagauccugagaagaagcggcggcaucggcaaggagagcaugggcuucaccuacagcggcaucagaaccaacggcgccaccagcgccugcaccagaagcggcagcagcuucuacgccgagaugaaguggcugcugagcaacagcgacaacagcgccuucccccagaugaccaaggccuacagaaaccccagaaacaagcccgcccugaucaucuggggcgugcaccacagcgagagcgugagcgagcagaccaagcuguacggcagcggcaacaagcugaucaccgugagaagcagcaaguaccagcagagcuucacccccagccccggcgccagaagaaucgacuuccacuggcugcugcuggaccccaacgacaccgugaccuucaccuucaacggcgccuucaucgcccccgacagagccagcuucuucagaggcgagagccugggcgugcagagcgacgugccccuggacagcagcugcagaggcgacugcuuccacagcggcggcaccaucgugagcagccugcccuuccagaacaucaacagcagaaccgugggcaagugccccagauacgugaagcagaagagccugcugcuggccaccggcaugagaaacgugcccgagaagcccaagcccagaggccuguucggcgccaucgccggcuucaucgagaacggcugggagggccugaucaacggcugguacggcuucagacaccagaacgcccagggcgagggcaccgccgccgacuacaagagcacccagagcgccaucgaccagaucaccggcaagcugaacagacugaucggcaagaccaaccagcaguucgagcugaucgacaacgaguucaacgagaucgagcagcagaucggcaacgugaucaacuggaccagagacgccaugaccgagaucuggagcuacaacgccgagcugcugguggccauggagaaccagcacaccaucgaccuggccgacagcgagaugagcaagcuguacgagagagugaagaagcagcugagagagaacgccgaggaggacggcaccggcugcuucgagaucuuccacaagugcgacgaccagugcauggagagcaucagaaacaacaccuacgaccacacccaguacagaaccgagagccugcagaacagaauccagaucgaccccgugaagcugagcagcggcuacaaggacaucauccugugguucagcuucggcgccagcugcuuccugcugcuggccaucgccaugggccugguguucaucugcaucaagaacggcaacaugcagugcaccaucugcauc

SEQ ID NO: 35948 - RNA, 1656 nt, Artificial Sequence
  derived and/or modified sequence opt4 from anti-influenza_Chain
augaacauccagauccuggccuucaucgccugcgugcugaccggcgccaagggcgacaagaucugccugggccaccacgccguggccaacggcaccaaggugaacacccugaccgagaagggcaucgagguggugaacgccaccgagaccguggagaccgccaacaucaagaagaucugcacccagggcaagagacccaccgaccugggccagugcggccugcugggcacccugaucggccccccccagugcgaccaguuccuggaguucagcagcgaccugaucaucgagagaagagagggcaccgacgugugcuaccccggcaaguucaccaacgaggagagccugagacagauccugagaagaagcggcggcaucggcaaggagagcaugggcuucaccuacagcggcaucagaaccaacggcgccaccagcgccugcaccagaagcggcagcagcuucuacgccgagaugaaguggcugcugagcaacagcgacaacgccgccuucccccagaugaccaagagcuacagaaaccccagaaacaagcccgcccugaucaucuggggcgugcaccacagcgagagcgugagcgagcagaccaagcuguacggcagcggcaacaagcugaucaaggugagaagcagcaaguaccagcagagcuucacccccaaccccggcgccagaagaaucgacuuccacuggcugcugcuggaccccaacgacaccgugaccuucaccuucaacggcgccuucaucgcccccgacagagccagcuucuucagaggcgagagcaucggcgugcagagcgacgccccccuggacagcagcugcggcggcaacugcuuccacaacggcggcaccaucgugagcagccugcccuuccagaacaucaaccccagaaccgugggcaagugccccagauacgugaagcagaagagccugcugcuggccaccggcaugagaaacgugcccgagaagcccaagaagagaggccuguucggcgccaucgccggcuucaucgagaacggcugggagggccugaucaacggcugguacggcuucagacaccagaacgcccagggcgagggcaccgccgccgacuacaagagcacccagagcgccaucgaccagaucaccggcaagcugaacagacugaucggcaagaccaaccagcaguucgagcugaucaacaacgaguucaacgagguggagcagcagaucggcaacgugaucaacuggacccaggacgccaugaccgagguguggagcuacaacgccgagcugcugguggccauggagaaccagcacaccaucgaccugaccgacagcgagaugagcaagcuguacgagagagugagaaagcagcugagagagaacgccgaggaggacggcaccggcugcuucgagaucuuccacaagugcgacgaccacugcauggagagcaucagaaacaacaccuacgaccacacccaguacagaaccgagagccugcagaacagaauccagaucgaccccgugaagcugagcggcggcuacaaggacaucauccugugguucagcuucggcgccagcugcuuccugcugcuggccaucgccaugggccugguguucaucugcaucaagaacggcaacaugcagugcaccaucugcauc

SEQ ID NO: 35949 - RNA, 1656 nt, Artificial Sequence
  derived and/or modified sequence opt4 from anti-influenza_Chain
gaccagaucugcaucggcuaccacgccaacaacagcaccgagcagguggacaccaucauggagaagaacgugaccgugacccacgcccagaacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaagaucagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccugacccuggccaucaugguggccggccugagccuguggaugugcagcaacggcagccugcagugcagaaucugcauc

SEQ ID NO: 35950 - RNA, 1656 nt, Artificial Sequence
  derived and/or modified sequence opt4 from anti-influenza_Chain
gaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaaccccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugauggccggccugagccuguggaugugcagcaacggcagccugcagugcagaaucugcauc

SEQ ID NO: 35951 - RNA, 1656 nt, Artificial Sequence; identical to SEQ ID NO: 35946
  derived and/or modified sequence opt4 from anti-influenza_Chain

SEQ ID NO: 35952 - RNA, 1656 nt, Artificial Sequence; identical to SEQ ID NO: 35947
  derived and/or modified sequence opt4 from anti-influenza_Chain

SEQ ID NO: 35953 - RNA, 1656 nt, Artificial Sequence; identical to SEQ ID NO: 35948
  derived and/or modified sequence opt4 from anti-influenza_Chain

SEQ ID NO: 35954 - RNA, 1656 nt, Artificial Sequence; identical to SEQ ID NO: 35949
  derived and/or modified sequence opt4 from anti-influenza_Chain

SEQ ID NO: 35955 - RNA, 1656 nt, Artificial Sequence; identical to SEQ ID NO: 35950
  derived and/or modified sequence opt4 from anti-influenza_Chain

SEQ ID NO: 35956 - RNA, 1680 nt, Artificial Sequence
  derived and/or modified sequence opt4 from anti-influenza_Chain
augagcaacauggacaucgacagcaucaacaccggcaccaucgacaagacccccgaggagcugacccccggcaccagcggcgccaccagacccaucaucaagcccgccacccuggccccccccagcaacaagagaaccagaaaccccagccccgagagaaccaccaccagcagcgagaccgacaucggcagaaagauccagaagaagcagacccccaccgagaucaagaagagcguguacaagaugguggugaagcugggcgaguucuacaaccagaugauggugaaggccggccugaacgacgacauggagagaaaccugauccagaacgcccaggccguggagagaauccugcuggccgccaccgacgacaagaagaccgaguaccagaagaagagaaacgccagagacgugaaggagggcaaggaggagaucgaccacaacaagaccggcggcaccuucuacaagauggugagagacgacaagaccaucuacuucagccccaucaagaucaccuuccugaaggaggaggugaagaccauguacaagaccaccaugggcagcgacggcuucagcggccugaaccacaucaugaucggccacagccagaugaacgacgugugcuuccagagaagcaagggccugaagagagugggccuggaccccagccugaucagcaccuucgccggcagcacccugcccagaagaagcggcaccaccggcguggccaucaagggcggcggcacccugguggacgaggccaucagauucaucggcagagccauggccgacagaggccugcugagagacaucaaggccaagaccgccuacgagaagauccugcugaaccugaagaacaagugcagcgccccccagcagaaggcccugguggaccaggugaucggcagcagaaaccccggcaucgccgacaucgaggaccugacccugcuggccagaagcauggugguggugagacccagcguggccagcaagguggugcugcccaucagcaucuacgccaagaucccccagcugggcuucaacaccgaggaguacagcauggugggcuacgaggccauggcccuguacaacauggccacccccgugagcauccugagaaugggcgacgacgccaaggacaagagccagcuguucuucaugagcugcuucggcgccgccuacgaggaccugagagugcugagcgcccugaccggcaccgaguucaagcccagaagcgcccugaagugcaagggcuuccacgugcccgccaaggagcagguggagggcaugggcgccgcccugaugagcaucaagcugcaguucugggcccccaugaccagaagcggcggcaacgaggugagcggcgagggcggcagcggccagaucagcugcagccccguguucgccguggagagacccaucgcccugagcaagcaggccgugagaagaaugcugagcaugaacguggagggcagagacgccgacgugaagggcaaccugcugaagaugaugaacgacagcauggccaagaagaccagcggcaacgccuucaucggcaagaagauguuccagaucagcgacaagaacaaggugaaccccaucgagauccccaucaagcagaccauccccaacuucuucuucggcagagacaccgccgaggacuacgacgaccuggacuac

SEQ ID NO: 35957 - RNA, 1680 nt, Artificial Sequence
  derived and/or modified sequence opt4 from anti-influenza_Chain
augaacacccagauccuggcccugaucgccuacaugcugaucggcgccaagggcgacaagaucugccugggccaccacgccguggccaacggcaccaaggugaacacccugaccgagagaggcaucgagguggugaacgccaccgagaccguggagaccgugaacaucaagaagaucugcacccagggcaagagacccaccgaccugggccagugcggccugcugggcacccugaucggccccccccagugcgaccaguuccuggaguucgacgccgaccugaucaucgagagaagagagggcaccgacgugugcuaccccggcaaguucaccaacgaggagagccugagacagauccugagaggcagcggcggcaucgacaaggagagcaugggcuucaccuacagcggcaucagaaccaacggcgugaccagcgccugcagaagaagcggcagcagcuucuacgccgagaugaaguggcugcugagcaacagcgacaacgccgccuucccccagaugaccaagagcuacagaaaccccagaaacaagcccgcccugaucaucuggggcgugcaccacagcggcagcgccaccgagcagaccaagcuguacggcagcggcaacaagcugaucaccgugggcagcagcaaguaccagcagagcuucacccccagccccggcgccagaccccaggugaacggccagagcggcagaaucgacuuccacuggcugcugcuggaccccaacgacaccgugaccuucaccuucaacggcgccuucaucgcccccgacagagccagcuucuucagaggcgagagccugggcgugcagagcgacgugccccuggacagcggcugcgagggcgacugcuuccacagcagaggcaccaucgugagcagccugcccuuccagaacaucaaccccagaaccgugggcaagugccccagauacgugaagcagaccagccugcugcuggccaccggcaugagaaacgugcccgagaaccccaagaccagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgacaagaccaaccagcaguucgagcugaucgacaacgaguucagcgagaucgagcagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaaagcagcugagagagaacgccgaggaggacggcaccggcugcuucgagaucuuccacaagugcgacgaccagugcauggagagcaucagaaacaacaccuacgaccacacccaguacagaaccgagagccugcagaacagaauccagaucgaccccgugaagcugagcagcggcuacaaggacaucauccugugguucagcuucggcgccagcugcuuccugcugcuggccaucgccaugggccugguguucaucugcaucaagaacggcaacaugagaugcaccaucugcauc

SEQ ID NO: 35958 - RNA, 1680 nt, Artificial Sequence
  derived and/or modified sequence opt4 from anti-influenza_Chain
augaacacccagauccuggcccugaucgccugcaugcugaucggcgccaagggcgacaagaucugccugggccaccacgccguggccaacggcaccaaggugaacacccugaccgagagaggcaucgagguggugaacgccaccgagaccguggagaccgccaacaucaagaagaucugcacccagggcaagagacccaccgaccugggccagugcggccugcugggcacccugaucggccccccccagugcgaccaguuccuggaguucgacgccgaccugaucaucgagagaagagagggcaccgacgugugcuaccccggcaaguucaccaacgaggagagccugagacagauccugagaggcagcggcggcaucgacaaggagagcaugggcuucaccuacagcggcaucagaaccaacggcgccaccagcgccugcagaagaagcggcagcagcuucuacgccgagaugaaguggcugcugagcaacagcgacaacgccgccuucccccagaugaccaagagcuacagaaaccccagaaacaagcccgcccugaucaucuggggcgugcaccacagcggcagcgccaccgagcagaccaagcuguacggcagcggcaacaagcugaucaccgugggcagcagcaaguaccagcagagcuucacccccagccccggcgccagaccccaggugaacggccagagcggcagaaucgacuuccacuggcugcugcuggaccccaacgacaccgugaccuucaccuucaacggcgccuucaucgcccccgacagagccagcuucuucagaggcggcagccugggcgugcagagcgacgugccccuggacagcggcugcgagggcgacugcuuccacagcggcggcaccaucgugagcagccugcccuuccagaacaucaaccccagaaccgugggcaagugccccagauacgugaagcagaccagccugcugcuggccaccggcaugagaaacgugcccgagaaccccaagaccagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgacaagaccaaccagcaguucgagcugaucgacaacgaguucaacgagaucgagcagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaaagcagcugagagagaacgccgaggaggacggcaccggcugcuucgagaucuuccacaagugcgacgaccagugcauggagagcaucagaaacaacaccuacgaccacacccaguacagaaccgagagccugcagaacagaauccagaucaaccccgugaagcugagcagcggcuacaaggacaucauccugugguucagcuucggcgccagcugcuuccugcugcuggccaucgccaugggccugguguucaucugcaucaagaacggcaacaugagaugcaccaucugcauc

SEQ ID NO: 35959 - RNA, 1680 nt, Artificial Sequence
  derived and/or modified sequence opt4 from anti-influenza_Chain
auggagagaaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagagaauccagaucauccccaagagcagcuggagcgaccacgaggccagcagcggcgugagcagcgccugccccuaccagggcagaagcagcuucuucagaaacgugguguggcugaucaagaagaacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaacugccagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggc

SEQ ID NO: 35960 - RNA, 1680 nt, Artificial Sequence; identical to SEQ ID NO: 35956
  derived and/or modified sequence opt4 from anti-influenza_Chain

SEQ ID NO: 35961 - RNA, 1680 nt, Artificial Sequence; identical to SEQ ID NO: 35957
  derived and/or modified sequence opt4 from anti-influenza_Chain

SEQ ID NO: 35962 - RNA, 1680 nt, Artificial Sequence; identical to SEQ ID NO: 35958
  derived and/or modified sequence opt4 from anti-influenza_Chain

SEQ ID NO: 35963 - RNA, 1680 nt, Artificial Sequence; identical to SEQ ID NO: 35959
  derived and/or modified sequence opt4 from anti-influenza_Chain

SEQ ID NO: 35964 - RNA, 1686 nt, Artificial Sequence
  derived and/or modified sequence opt4 from anti-influenza_Chain
augcccagagcccugagaagagugcccggcagcagagugaugcugagagugggcguggugguggccgugcuggcccugguggccgcccuggccaaccuggccgugcccagacccgccagagccgccggcggcggcuacuggcacaccagcggcagagagauccuggacgccaacaacgugcccgugagaaucgccggcaucaacugguucggcuucgagaccugcaacuacguggugcacggccuguggagcagagacuacagaagcaugcuggaccagaucaagagccugggcuacaacaccaucagacugcccuacagcgacgacauccugaagcccggcaccaugcccaacagcaucaacuucuaccagaugaaccaggaccugcagggccugaccagccugcaggugauggacaagaucguggccuacgccggccagaucggccugagaaucauccuggacagacacagacccgacugcagcggccagagcgcccugugguacaccagcagcgugagcgaggccaccuggaucagcgaccugcaggcccuggcccagagauacaagggcaaccccaccguggugggcuucgaccugcacaacgagccccacgaccccgccugcuggggcugcggcgaccccagcaucgacuggagacuggccgccgagagagccggcaacgccgugcugagcgugaaccccaaccugcugaucuucguggagggcgugcagagcuacaacggcgacagcuacugguggggcggcaaccugcagggcgccggccaguaccccguggugcugaacgugcccaacagacugguguacagcgcccacgacuacgccaccagcguguacccccagaccugguucagcgaccccaccuuccccaacaacaugcccggcaucuggaacaagaacuggggcuaccuguucaaccagaacaucgcccccguguggcugggcgaguucggcaccacccugcagagcaccaccgaccagaccuggcugaagacccuggugcaguaccugagacccaccgcccaguacggcgccgacagcuuccaguggaccuucuggagcuggaaccccgacagcggcgacaccggcggcauccugaaggacgacuggcagaccguggacaccgugaaggacggcuaccuggcccccaucaagagcagcaucuucgaccccgugggcgccagcgccagccccagcagccagcccagccccagcgugagccccagccccagccccagccccagcgccagcagaacccccacccccacccccacccccaccgccagccccacccccacccugacccccaccgccacccccacccccaccgccagccccacccccagccccaccgccgccagcggcgccagaugcaccgccagcuaccaggugaacagcgacuggggcaacggcuucaccgugaccguggccgugaccaacagcggcagcguggccaccaagaccuggaccgugagcuggaccuucggcggcaaccagaccaucaccaacagcuggaacgccgccgugacccagaacggccagagcgugaccgccagaaacaugagcuacaacaacgugauccagcccggccagaacaccaccuucggcuuccaggccagcuacaccggcagcaacgccgcccccaccguggccugcgccgccagc

SEQ ID NO: 35965 - RNA, 1686 nt, Artificial Sequence
  derived and/or modified sequence opt4 from anti-influenza_Chain
auggagagagugugguggaaggaggccgugguguaccagaucuaccccagaagcuucuacgacagcaacggcgacggcaucggcgacaucagaggcaucaucgccaagcuggacuaccugaaggagcugggcguggacgugguguggcugagccccguguacaagagccccaacgacgacaacggcuacgacaucagcgacuacagagacaucauggacgaguucggcaccauggccgacuggaagaccaugcuggaggagaugcacaagagaggcaucaagcuggugauggaccugguggugaaccacaccagcgacgagcaccccugguucaucgagagcagaaagagcaaggacaaccccuacagagacuacuacaucuggagacccggcaagaacggcaaggagcccaacaacugggagagcguguucagcggcagcgccugggaguacgacgagaugaccggcgaguacuaccugcaccuguucagcaagaagcagcccgaccugaacugggagaaccccaaggugagaagagagguguacgagaugaugaaguucuggcuggacaagggcguggacggcuucagaauggacgugaucaacaugaucagcaaggugcccgagcugcccgacggcgagccccagagcggcaagaaguacgccagcggcagcagauacuacaugaacggccccagagugcacgaguuccugcaggagaugaacagagaggugcugagcaaguacgacaucaugaccgugggcgagacccccggcgugacccccaaggagggcauccuguacaccgaccccagcagaagagagcugaacaugguguuccaguucgagcacauggaccuggacagcggccccggcggcaagugggacaucagacccuggagccuggccgaccugaagaagaccaugaccaaguggcagaaggagcuggagggcaagggcuggaacagccuguaccugaacaaccacgaccagcccagagccgugagcagauucggcgacgacggcaaguacagaguggagagcgccaagaugcuggccaccuuccugcacaugaugcagggcacccccuacaucuaccagggcgaggagaucggcaugaccaacgugagauuccccagcaucgaggacuacagagacaucgagacccugaacauguacaaggagagaguggaggaguacggcgaggacccccaggaggugauggagaagaucuacuacaagggcagagacaacgccagaacccccaugcagugggacgacagcgagaacgccggcuucaccgccggcacccccuggauccccgugaaccccaacuacaaggagaucaacgugaaggccgcccuggaggaccccaacagcguguuccacuacuacaagaagcugauccagcugagaaagcagcacgacaucaucguguacggcaccuacgaccugauccuggaggacgaccccuacaucuacagauacaccagaacccugggcaacgagcagcugaucgugaucaccaacuucagcgagaagacccccguguucagacugcccgaccacaucaucuacaagaccaaggagcugcugaucagcaacuacgacguggacgaggccgaggagcugaaggagaucagacugagacccugggaggccagaguguacaagaucagacugccc

SEQ ID NO: 35966 - RNA, 1686 nt, Artificial Sequence; identical to SEQ ID NO: 35964
  derived and/or modified sequence opt4 from anti-influenza_Chain

SEQ ID NO: 35967 - RNA, 1686 nt, Artificial Sequence; identical to SEQ ID NO: 35965
  derived and/or modified sequence opt4 from anti-influenza_Chain

SEQ ID NO: 35968 - RNA, 1689 nt, Artificial Sequence
  derived and/or modified sequence opt4 from anti-influenza_Chain
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagaccagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugc

SEQ ID NO: 35969 - RNA, 1689 nt, Artificial Sequence; identical to SEQ ID NO: 35968
  derived and/or modified sequence opt4 from anti-influenza_Chain

SEQ ID NO: 35970 - RNA, 1692 nt, Artificial Sequence
  derived and/or modified sequence opt4 from anti-influenza_Chain
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcagccugaacggcgugaagccccugauccugagagacugcagcguggccggcuggcugcugggcaaccccaugugcgacgaguuccugaacgugcccgaguggagcuacaucguggagaaggacagccccaucaacggccugugcuaccccggcgacuucaacgacuacgaggagcugaagcaccugcugagcagcaccaaccacuucgagaagauccagaucauccccagaagcagcuggagcgaccacgacgccagcagcggcgugagcagcgccugccccuacaacggcagaagcagcuucuucagaaacgugguguggcugaucaagaagaacaacgccuaccccaccaucaagagaaacuacaacaacaccaaccaggaggaccugcuggugcuguggggcauccaccaccccaacgacgccaccgagcagaccaagcuguaccagaaccccaccaccuacgugagcgugggcaccagcacccugaaccagagaagcgugcccgagaucgccaccagacccaaggugaacggccagagcggcagaaucgaguucuucuggaccauccugaagcccaacgacgccaucaacuucgagagcaacggcaacuucaucgcccccgaguacgccuacaagaucgccaagaagggcgacagcgccaucaugaagagcggccuggaguacggcaacugcaacaccaagugccagacccccaugggcgccaucaacagcagcaugcccuuccacaacauccacccccugaccaucggcgagugccccagauacgugaagagcgacagacuggugcuggccaccggccugagaaacgugccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcaucaccaacaaggugaacagcaucaucgacaagaugaacacccaguucgaggccgugggcaaggaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacgacgagugcauggagagcgugagaaacggcaccuacgacuacccccaguacagcgaggaggccagacugaacagagaggagaucagcggcgugaagcuggagagcaucggcaccuaccagauccugagcaucuacagcaccguggccagcagccuggcccuggccaucaugguggccggccugagcuucuggaugugcagcaacggcagccugcagugcagaaucugcauc

SEQ ID NO: 35971 - RNA, 1692 nt, Artificial Sequence; identical to SEQ ID NO: 35970
  derived and/or modified sequence opt4 from anti-influenza_Chain

SEQ ID NO: 35972 - RNA, 1695 nt, Artificial Sequence
  derived and/or modified sequence opt4 from anti-influenza_Chain
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcaga

SEQ ID NO: 35973 - RNA, 1695 nt, Artificial Sequence
  derived and/or modified sequence opt4 from anti-influenza_Chain
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcaga

SEQ ID NO: 35974 - RNA, 1695 nt, Artificial Sequence
  derived and/or modified sequence opt4 from anti-influenza_Chain
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcaagagcagcuucuucagaaacgugguguggcugaucaagaagaacagcagcuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcaga

SEQ ID NO: 35975 - RNA, 1695 nt, Artificial Sequence
  derived and/or modified sequence opt4 from anti-influenza_Chain
augagcgacagaagacagaacagaaagacccccgacgagcagagaaaggccaacgcccugaucaucaacgagaacaucgaggccuacaucgccaucugcaaggaggugggccugaacggcgacgagaugcugauccuggagaacggcaucgccaucgagaaggccaucagaaucugcugcgacggcaaguaccaggagaagagagagaagaaggccagagaggcccagagagccgacagcaacuucaacgccgacagcaucggcaucagacuggugaagagagccggcagcggcaccaacaucaccuaccacgccgugguggagcugaccagcagaagcagaaucgugcagauccugaagagccacuggggcaacgagcugaacagagccaagaucgccggcaagagacugggcuucagcgcccuguucgccagcaaccuggaggccaucaucuaccagagaggcagaaacgccgccagaagaaacggcagcgccgagcuguucacccugacccagggcgccggcaucgagaccagauacaaguggaucauggagaagcacaucggcaucggcgugcugaucgccgacgccaagggccugaucaacggcaagagagagggcaagagaggcguggacgccaacgugaagcugagagccggcaccaccggcagcccccuggagagagccaugcagggcaucgagaagaaggccuuccccggcccccugagagcccuggccagaagaguggugaaggccaacuacaacgacgccagagaggcccugaacgugaucgccgaggccagccugcugcugaagccccagaucaccaacaagaugaccaugcccuggugcauguggcuggccgccagacugacccugaaggacgaguucgccaacuucugcgccuacgccggcagaagagccuucgagguguucaacaucgccauggagaagaucggcaucugcagcuuccagggcaccaucaugaacgacgacgagaucgagagcaucgaggacaaggcccaggugcugaugauggccugcuucggccuggccuacgaggacuucagccuggugagcgccauggugagccacccccugaagcugagaaacagaaugaagaucggcaacuucagagugggcgagaaggugagcaccgugcugagcccccugcugagauucaccagaugggccgaguucgcccagagauucgcccugcaggccaacaccagcagagagggcgcccagaucagcaacagcgccguguucgccguggagagaaagaucaccaccgacgugcagagaguggaggagcugcugaacaaggugcaggcccacgaggacgagccccugcagacccuguacaagaaggugagagagcagaucagcaucaucggcagaaacaagagcgagaucaaggaguuccugggcagcagcauguacgaccugaacgaccaggagaagcagaaccccaucaacuucagaagcggcgcccaccccuucuucuucgaguucgaccccgacuacaaccccaucagagugaagagacccaagaagcccaucgccaagagaaacagcaacaucagcagacuggaggaggagggcauggacgagaacagcgagaucggccaggccaagaagaugaagccccuggaccagcugaccagcaccagcagcaacauccccggcaagaac

SEQ ID NO: 35976 - RNA, 1695 nt, Artificial Sequence
  derived and/or modified sequence opt4 from anti-influenza_Chain
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuaccacuggacccugcuggagcccggcgacaccaucaucuucgaggccaacggcaaccugaucgcccccagauacgccuucacccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcauc

SEQ ID NO: 35977 - RNA, 1695 nt, Artificial Sequence
  derived and/or modified sequence opt4 from anti-influenza_Chain
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcauc

SEQ ID NO: 35978 - RNA, 1695 nt, Artificial Sequence
  derived and/or modified sequence opt4 from anti-influenza_Chain
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccgacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcauc

SEQ ID NO: 35979 - RNA, 1695 nt, Artificial Sequence
  derived and/or modified sequence opt4 from anti-influenza_Chain
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcauc

SEQ ID NO: 35980 - RNA, 1695 nt, Artificial Sequence
  derived and/or modified sequence opt4 from anti-influenza_Chain
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcauc

SEQ ID NO: 35981 - RNA, 1695 nt, Artificial Sequence
  derived and/or modified sequence opt4 from anti-influenza_Chain
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcauc

SEQ ID NO: 35982 - RNA, 1677 nt, Artificial Sequence
  derived and/or modified sequence opt4 from anti-influenza_Chain
gacaagaucugcaucggcuaccagagcaccaacagcaccgagaccguggacacccugaccaagaccaacgugcccgugacccaggccaaggagcugcugcacaccgagcacaacggcaugcugugcgccaccaaccugggccacccccugauccuggacaccugcaccaucgagggccugaucuacggcaaccccagcugcgaccugcugcugggcggcagagaguggagcuacaucguggagagacccagcgccgugaacggcaugugcuaccccggcaacguggagaaccuggaggagcugagacugcuguucagcagcgccagcagcuaccagagagugcagaucuuccccgacaccaucuggaacgugaccuacagcggcaccagcagcgccugcagcaacagcuucuacagaagcaugagauggcugacccagaaggacaacaccuaccccgugcaggacgcccaguacaccaacaacagaggcaagagcauccuguucauguggggcaucaaccacccccccaccgacaccgugcagaccaaccuguacaccagaaccgacaccaccaccagcgugaccaccgaggacaucaacagagccuucaagcccgugaucggccccagaccccuggugaacggccugcagggcagaaucgacuacuacuggagcgugcugaagcccggccagacccugagagugagaagcaacggcaaccugaucgcccccugguacggccacauccugagcggcgagagccacggcagaauccugaagagcgaccugaacagcggcaacugcguggugcagugccagaccgagagaggcggccugaacaccacccugcccuuccacaacgugagcaaguacgccuucggcaacugccccaaguacgugggcgugaagagccugaagcuggccgugggcaugagaaacgugcccgccagaagcagcagaggccuguucggcgccaucgccggcuucaucgagggcggcuggcccggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagaucgagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgacagaugcauggagaccaucagaaacggcaccuacaacagaggcaaguacaaggaggagagcagacuggagagacagaagaucgagggcgugaagcuggagagcgagggcaccuacaagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 35983 - RNA, 1677 nt, Artificial Sequence; identical to SEQ ID NO: 35982
  derived and/or modified sequence opt4 from anti-influenza_Chain

SEQ ID NO: 35984 - RNA, 1695 nt, Artificial Sequence; identical to SEQ ID NO: 35975
  derived and/or modified sequence opt4 from anti-influenza_Chain

SEQ ID NO: 35985 - RNA, 1695 nt, Artificial Sequence; identical to SEQ ID NO: 35972
  derived and/or modified sequence opt4 from anti-influenza_Chain

SEQ ID NO: 35986 - RNA, 1695 nt, Artificial Sequence; identical to SEQ ID NO: 35973
  derived and/or modified sequence opt4 from anti-influenza_Chain

SEQ ID NO: 35987 - RNA, 1695 nt, Artificial Sequence; identical to SEQ ID NO: 35974
  derived and/or modified sequence opt4 from anti-influenza_Chain

SEQ ID NO: 35988 - RNA, 1695 nt, Artificial Sequence; identical to SEQ ID NO: 35976
  derived and/or modified sequence opt4 from anti-influenza_Chain

SEQ ID NO: 35989 - RNA, 1695 nt, Artificial Sequence; identical to SEQ ID NO: 35977
  derived and/or modified sequence opt4 from anti-influenza_Chain

SEQ ID NO: 35990 - RNA, 1695 nt, Artificial Sequence; identical to SEQ ID NO: 35978
  derived and/or modified sequence opt4 from anti-influenza_Chain

SEQ ID NO: 35991 - RNA, 1695 nt, Artificial Sequence; identical to SEQ ID NO: 35979
  derived and/or modified sequence opt4 from anti-influenza_Chain

SEQ ID NO: 35992 - RNA, 1695 nt, Artificial Sequence; identical to SEQ ID NO: 35980
  derived and/or modified sequence opt4 from anti-influenza_Chain

SEQ ID NO: 35993 - RNA, 1695 nt, Artificial Sequence; identical to SEQ ID NO: 35981
  derived and/or modified sequence opt4 from anti-influenza_Chain

SEQ ID NO: 35994 - RNA, 1698 nt, Artificial Sequence
  derived and/or modified sequence opt4 from anti-influenza_Chain
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccagcaucggcagcagacccagaaucagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcauc

SEQ ID NO: 35995 - RNA, 1698 nt, Artificial Sequence
  derived and/or modified sequence opt4 from anti-influenza_Chain
augaagaccaucaucgcccugagcuacauccugugccuggugagcgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucagaagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcauc

SEQ ID NO: 35996 - RNA, 1698 nt, Artificial Sequence
  derived and/or modified sequence opt4 from anti-influenza_Chain
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaagaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaaggagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacugagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcauc

SEQ ID NO: 35997 - RNA, 1698 nt, Artificial Sequence
  derived and/or modified sequence opt4 from anti-influenza_Chain
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaagugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcauc

SEQ ID NO: 35998 - RNA, 1698 nt, Artificial Sequence
  derived and/or modified sequence opt4 from anti-influenza_Chain
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcauc

SEQ ID NO: 35999 - RNA, 1698 nt, Artificial Sequence
  derived and/or modified sequence opt4 from anti-influenza_Chain
augaagaccaucaucgcccugagcuacauccugugccugguguucagccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccgugaccgacagcgaccagaucagccuguacgcccaggccagcggcagaaucaccgugagcaccaagagaagccagcagaccgugauccccaacaucggcuacagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcauc

SEQ ID NO: 36000 - RNA, 1698 nt, Artificial Sequence
  derived and/or modified sequence opt4 from anti-influenza_Chain
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacuggaccggcgugacccagaacggcaccagcagcagcugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccgugaccgacaacgaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcauc

SEQ ID NO: 36001 - RNA, 1698 nt, Artificial Sequence
  derived and/or modified sequence opt4 from anti-influenza_Chain
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucugggccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcauc

SEQ ID NO: 36002 - RNA, 1698 nt, Artificial Sequence
  derived and/or modified sequence opt4 from anti-influenza_Chain
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcauc

SEQ ID NO: 36003 - RNA, 1698 nt, Artificial Sequence
  derived and/or modified sequence opt4 from anti-influenza_Chain
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcauc

SEQ ID NO: 36004 - RNA, 1698 nt, Artificial Sequence; identical to SEQ ID NO: 36001
  derived and/or modified sequence opt4 from anti-influenza_Chain

SEQ ID NO: 36005 - RNA, 1698 nt, Artificial Sequence; identical to SEQ ID NO: 35994
  derived and/or modified sequence opt4 from anti-influenza_Chain

SEQ ID NO: 36006 - RNA, 1698 nt, Artificial Sequence; identical to SEQ ID NO: 36002
  derived and/or modified sequence opt4 from anti-influenza_Chain

SEQ ID NO: 36007 - RNA, 1698 nt, Artificial Sequence; identical to SEQ ID NO: 36003
  derived and/or modified sequence opt4 from anti-influenza_Chain

SEQ ID NO: 36008 - RNA, 1698 nt, Artificial Sequence; identical to SEQ ID NO: 35995
  derived and/or modified sequence opt4 from anti-influenza_Chain

SEQ ID NO: 36009 - RNA, 1698 nt, Artificial Sequence; identical to SEQ ID NO: 35996
  derived and/or modified sequence opt4 from anti-influenza_Chain

SEQ ID NO: 36010 - RNA, 1698 nt, Artificial Sequence; identical to SEQ ID NO: 35997
  derived and/or modified sequence opt4 from anti-influenza_Chain

SEQ ID NO: 36011 - RNA, 1698 nt, Artificial Sequence; identical to SEQ ID NO: 35998
  derived and/or modified sequence opt4 from anti-influenza_Chain

SEQ ID NO: 36012 - RNA, 1698 nt, Artificial Sequence; identical to SEQ ID NO: 35999
  derived and/or modified sequence opt4 from anti-influenza_Chain

SEQ ID NO: 36013 - RNA, 1698 nt, Artificial Sequence; identical to SEQ ID NO: 36000
  derived and/or modified sequence opt4 from anti-influenza_Chain

SEQ ID NO: 36014 - RNA, 1683 nt, Artificial Sequence
  derived and/or modified sequence opt4 from anti-influenza_Chain
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccagcacagcggcggcagaagcagccuggagggccccagauucgagcagaagcugaucagcgaggaggaccugaacaugcacaccggc

SEQ ID NO: 36015 - RNA, 1683 nt, Artificial Sequence
  derived and/or modified sequence opt4 from anti-influenza_Chain
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcaagagcagcuucuucagaaacgugguguggcugaucaagaagaacagcagcuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccagcacagcggcggcagaagcagccuggagggccccagauucgagcagaagcugaucagcgaggaggaccugaacaugcacaccggc

SEQ ID NO: 36016 - RNA, 1701 nt, Artificial Sequence
  derived and/or modified sequence opt4 from anti-influenza_Chain
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucaucagcaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacaacgccgccgagcagaccaagcuguaccagaaccccaccaccuacaucagcgugggcaccagcacccugaaccugagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcauc

SEQ ID NO: 36017 - RNA, 1701 nt, Artificial Sequence
  derived and/or modified sequence opt4 from anti-influenza_Chain
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucgugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcauc

SEQ ID NO: 36018 - RNA, 1683 nt, Artificial Sequence
  derived and/or modified sequence opt4 from anti-influenza_Chain
gacaagaucugccugggccaccacgccgugagcaacggcaccaaggugaacacccugaccgagagaggcguggagguggugaacgccaccgagaccguggagagaaccaacgugcccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcaccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugauccugaaccccaacgacaccgugaccuucagcuucaacggcgccuucaucgcccccgacagagccagcuuccugagaggcaagagcaugggcauccagagcgaggugcagguggacgccaacugcgagggcgacugcuaccacagcggcggcaccaucaucagcaaccugcccuuccagaacaucaacagcagagccgugggcaagugccccagauacgugaagcaggagagccugcugcuggccaccggcaugaagaacgugcccgagauccccaagagaagaagaagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccauccagaacagaauccagaucgaccccgugaagcugagcagcggcuacaaggacagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36019 - RNA, 1701 nt, Artificial Sequence
  derived and/or modified sequence opt4 from anti-influenza_Chain
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcgacagcgccaucgugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcauc

SEQ ID NO: 36020 - RNA, 1683 nt, Artificial Sequence; identical to SEQ ID NO: 36018
  derived and/or modified sequence opt4 from anti-influenza_Chain

SEQ ID NO: 36021 - RNA, 1683 nt, Artificial Sequence; identical to SEQ ID NO: 36014
  derived and/or modified sequence opt4 from anti-influenza_Chain

SEQ ID NO: 36022 - RNA, 1683 nt, Artificial Sequence; identical to SEQ ID NO: 36015
  derived and/or modified sequence opt4 from anti-influenza_Chain

SEQ ID NO: 36023 - RNA, 1701 nt, Artificial Sequence; identical to SEQ ID NO: 36019
  derived and/or modified sequence opt4 from anti-influenza_Chain

SEQ ID NO: 36024 - RNA, 1701 nt, Artificial Sequence; identical to SEQ ID NO: 36016
  derived and/or modified sequence opt4 from anti-influenza_Chain

SEQ ID NO: 36025 - RNA, 1701 nt, Artificial Sequence; identical to SEQ ID NO: 36017
  derived and/or modified sequence opt4 from anti-influenza_Chain

SEQ ID NO: 36026 - RNA, 1704 nt, Artificial Sequence
  derived and/or modified sequence opt4 from anti-influenza_Chain
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcgacuucaacgacuacgaggagcugaagcaccugcugagcagaaucaaccacuucgagaagauccagaucauccccaagagcagcuggagcgacuacgaggccagcagcggcgugagcagcgccugccccuaccagggcagaagcagcuucuucagaaacgugguguggcugaucaagaagaacaacgccuaccccaccaucaagagaagcuacaacaacaccaaccaggaggaccugcuggugcuguggggcauccaccaccccaacgacgccgccgagcagaucagacuguaccagaaccccaccaccuacaucagcaucggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucaacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaugggcaucuaccagauccugagcaucuacagcaccguggccagcagccuggcccuggccaucaugguggccggccuguuccuguggaugugcagcaacggcagccugcagugcagaaucugcauc

SEQ ID NO: 36027 - RNA, 1704 nt, Artificial Sequence
  derived and/or modified sequence opt4 from anti-influenza_Chain
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugauggccggccugagccuguggaugugcagcaacggcagccugcagugcagaaucugcauc

SEQ ID NO: 36028 - RNA, 1704 nt, Artificial Sequence
  derived and/or modified sequence opt4 from anti-influenza_Chain
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcauc

SEQ ID NO: 36029 - RNA, 1704 nt, Artificial Sequence; identical to SEQ ID NO: 36026
  derived and/or modified sequence opt4 from anti-influenza_Chain

SEQ ID NO: 36030 - RNA, 1704 nt, Artificial Sequence; identical to SEQ ID NO: 36027
  derived and/or modified sequence opt4 from anti-influenza_Chain

SEQ ID NO: 36031 - RNA, 1704 nt, Artificial Sequence; identical to SEQ ID NO: 36028
  derived and/or modified sequence opt4 from anti-influenza_Chain

SEQ ID NO: 36032 - RNA, 1707 nt, Artificial Sequence
  derived and/or modified sequence opt4 from anti-influenza_Chain
agcaagagcagaggcuacaagaugaacacccagauccugguguucgcccugguggccagcauccccaccaacgccgacaagaucugccugggccaccacgccgugagcaacggcaccaaggugaacacccugaccgagagaggcguggagguggugaacgccaccgagaccguggagagaaccaacgugcccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcaccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugauccugaaccccaacgacaccgugaccuucagcuucaacggcgccuucaucgcccccgacagagccagcuuccugagaggcaagagcaugggcauccagagcgaggugcagguggacgccaacugcgagggcgacugcuaccacagcggcggcaccaucaucagcaaccugcccuuccagaacaucaacagcagagccgugggcaagugccccagauacgugaagcaggagagccugcugcuggccaccggcaugaagaacgugcccgagauccccaagagaagaagaagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagagacagaucggcaacgugaucaacuggaccagagacagcaugaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccauccagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcauc

SEQ ID NO: 36033 - RNA, 1707 nt, Artificial Sequence; identical to SEQ ID NO: 36032
  derived and/or modified sequence opt4 from anti-influenza_Chain

SEQ ID NO: 36034 - RNA, 1692 nt, Artificial Sequence
  derived and/or modified sequence opt4 from anti-influenza_Chain
gaccagaucugcaucggcuaccacgccaacaacagcaccgagaagguggacaccaaccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaaggagggcagcgacuaccccguggccaagggcagcuacaacaacaccagcggcgagcagaugcugaucaucuggggcgugcaccaccccaucgacgagaccgagcagagaacccuguaccagaacgugggcaccuacgugagcgugggcaccagcacccugaacaagagaagcacccccgagaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucggcaaccuggagagaagacuggagaaccugaacaagagaauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36035 - RNA, 1692 nt, Artificial Sequence
  derived and/or modified sequence opt4 from anti-influenza_Chain
cagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacuggaccggcgugacccagaacggcaccagcagcagcugcaagagaagaagcaacaacagcuucuucagcagacugaacuggcugacccagcugaaguucaaguaccccgcccugaacgugaccaugcccaacaacgagaaguucgacaagcuguacaucuggggcgugcaccaccccgugaccgacaacgaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36036 - RNA, 1692 nt, Artificial Sequence; identical to SEQ ID NO: 36034
  derived and/or modified sequence opt4 from anti-influenza_Chain

SEQ ID NO: 36037 - RNA, 1692 nt, Artificial Sequence; identical to SEQ ID NO: 36035
  derived and/or modified sequence opt4 from anti-influenza_Chain

SEQ ID NO: 36038 - RNA, 1695 nt, Artificial Sequence
  derived and/or modified sequence opt4 from anti-influenza_Chain
gacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36039 - RNA, 1695 nt, Artificial Sequence
  derived and/or modified sequence opt4 from anti-influenza_Chain
cagaacuacaccggcaaccccgugaucugccugggccaccacgccgugagcaacggcaccauggugaagacccugaccgacgaccagaucgagguggugaccgcccaggagcugguggagagccagcaccugcccgagcugugccccagcccccugagacugguggacggccagaccugcgacaucgugaacggcgcccugggcagccccggcugcgaccaccugaacggcgccgagugggacguguucaucgagagacccaccgccguggacaccugcuaccccuucgacgugcccgacuaccagagccugagaagcauccuggccaacaacggcaaguucgaguucaucgccgaggaguuccaguggaacaccgugaagcagaacggcaagagcggcgccugcaagagagccaacgugaacgacuucuucaacagacugaacuggcugaccaagagcgacggcaacgccuacccccugcagaaccugaccaaggugaacaacggcgacuacgccagacuguacaucuggggcgugcaccaccccagcaccgacaccgagcagaccaaccuguacaagaacaaccccggcagagugaccgugagcacccagaccagccagaccagcguggugcccaacaucggcagcagacccugggugagaggccugagcagcagaaucagcuucuacuggaccaucguggagcccggcgaccugaucguguucaacaccaucggcaaccugaucgcccccagaggccacuacaagcugaacagccagaagaagagcaccauccugaacaccgccgugcccaucggcagcugcgugagcaagugccacaccgacaagggcagcaucagcaccaccaagcccuuccagaacaucagcagaaucagcaucggcgacugccccaaguacgugaagcagggcagccugaagcuggccaccggcaugagaagcauccuggagaaggccaccagaggccuguucggcgccaucgccggcuucaucgagaacggcuggcagggccugaucgacggcugguacggcuucagacaccagaacgccgagggcaccggcaccgccgccgaccugaagagcacccaggccgccaucgaccagaucaacggcaagcugaacagacugaucggcaagcccaacgagaaguaccaccagaucgagaaggaguucgagcagguggagggcagaauccaggaccuggagaaguacguggaggacaccaagaucgaccuguggagcuacaacgccgagcugcugguggcccuggagaaccagcacaccaucgacgugaccgacagcgagaugaacaagcuguucgagagagugagacaccagcugagagagaacgccgaggacaagggcaacggcugcuucgagaucuuccaccagugcgacaacagcugcaucgagagcaucagaaacggcaccuacgaccacgacaucuacagagacgaggccaucaacaacagauuccagauccagggcgugaagcugauccagggcuacaaggacagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36040 - RNA, 1695 nt, Artificial Sequence
  derived and/or modified sequence opt4 from anti-influenza_Chain
gaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugaaggacugcagcguggccggcuggcugcugggcaaccccaugugcgacgaguuccugaacgugagcgaguggagcuacaucguggagaaggccagccccgccaacggccugugcuaccccggcgacuucaacgacuacgaggagcugaagcaccugcugagcagaaucaaccaccugaagaagaucaagaucauccccaagagcuacuggagcaaccacgaggccagcagcggcgugagcgccgccugcagcuaccugggcgagcccagcuucuucagaaacgugguguggcugaucaagaagaacaacaccuacccccccaucaaggugaacuacaccaacaccaaccaggaggaccugcuggugcuguggggcauccaccaccccaacgacgagaaggagcagaucagaaucuaccagaaccccaacaccagcaucagcgugggcaccagcacccugaaccagagacuggugcccaagaucgccaccagacccaaggugaacggccagagcggcagaauggaguucuucuggaccauccugaagcccaacgacagcaucaacuucgacagcaacggcaacuucaucgcccccgaguacgccuacaagaucgccaagaagggcgacagcgugaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacgccccccagaccgagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcaucaccaacaaggugaacagcaucaucgacaagaugaacacccaguucgagaucgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgagaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugagcagagaggagaucagcggcgugaagauggagagcauggugaccuaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36041 - RNA, 1695 nt, Artificial Sequence; identical to SEQ ID NO: 36038
  derived and/or modified sequence opt4 from anti-influenza_Chain

SEQ ID NO: 36042 - RNA, 1695 nt, Artificial Sequence; identical to SEQ ID NO: 36039
  derived and/or modified sequence opt4 from anti-influenza_Chain

SEQ ID NO: 36043 - RNA, 1695 nt, Artificial Sequence; identical to SEQ ID NO: 36040
  derived and/or modified sequence opt4 from anti-influenza_Chain

SEQ ID NO: 36044 - RNA, 1698 nt, Artificial Sequence
  derived and/or modified sequence opt4 from anti-influenza_Chain
gacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36045 - RNA, 1698 nt, Artificial Sequence
  derived and/or modified sequence opt4 from anti-influenza_Chain
gacagaaucugcaucggcuaccagagcaacaacagcaccgacaccgugaacacccugaucgagcagaaggugcccgugacccagaccauggagcugguggagaccgagaagcaccccgccuacugcaacaccgaccugggcgccccccuggagcugagagacugcaagaucgaggccgugaucuacggcaaccccaagugcgacauccaccugaaggaccagggcuggagcuacaucguggagagacccagcgcccccgagggcaugugcuaccccggcagcguggagaaccuggaggagcugagauucguguucagcagcgccgccagcuacaagagaaucagacuguucgacuacagcagauggaacgugaccagcagcggcaccagcaaggccugcaacgccagcaccggcggccagagcuucuacagaagcaucaacuggcugaccaagaagaagcccgacaccuacgacuucaacgagggcaccuacgugaacaacgaggacggcgacaucaucuuccuguggggcauccaccacccccccgacaccaaggagcagaccacccuguacaagaacgccaacacccugagcagcgugaccaccaacaccaucaacagaagcuuccagcccaacaucggccccagaccccuggugagaggccagcagggcagaauggacuacuacuggggcauccugaagagaggcgagacccugaagaucagaaccaacggcaaccugaucgcccccgaguucggcuaccugcugaagggcgagagccacggcagaaccauccagaacgaggacauccccaucggcaacugcuacaccaagugccagaccuacgccggcgccaucaacagcagcaagcccuuccagaacgccagcagacacuacaugggcgagugccccaaguacgugaagaaggccagccugagacuggccgugggccugagaaacacccccagcguggagcccagaggccuguucggcgccaucgccggcuucaucgagggcggcuggagcggcaugaucgacggcugguacggcuuccaccacagcaacagcgagggcaccggcauggccgccgaccagaagagcacccaggaggccaucgacaagaucaccaacaaggugaacaacaucguggacaagaugaacagagaguucgagguggugaaccacgaguucagcgagguggagaagagaaucaacaugaucaacgacaagaucgacgaccagaucgaggaccugugggccuacaacgccgagcugcuggugcugcuggagaaccagaagacccuggacgagcacgacagcaacgugaagaaccuguucgacgaggugaagagaagacugagcgccaacgccaucgacgccggcaacggcugcuucgacauccugcacaagugcgacaacgagugcauggagaccaucaagaacggcaccuacgaccacaaggaguacgaggaggaggccaagcuggagagaagcaagaucaacggcgugaagcuggaggagaacaccaccuacaagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36046 - RNA, 1698 nt, Artificial Sequence; identical to SEQ ID NO: 36044
  derived and/or modified sequence opt4 from anti-influenza_Chain

SEQ ID NO: 36047 - RNA, 1698 nt, Artificial Sequence; identical to SEQ ID NO: 36045
  derived and/or modified sequence opt4 from anti-influenza_Chain

SEQ ID NO: 36048 - RNA, 1701 nt, Artificial Sequence
  derived and/or modified sequence opt4 from anti-influenza_Chain
gacaagaucugcaucggcuaccacgccaacaacagcaccacccagguggacaccauccuggagaagaacgugaccgugacccacagcguggagcugcuggagaaccagaaggaggagagauucugcaagauccugaacaaggccccccuggaccugagaggcugcaccaucgagggcuggauccugggcaacccccagugcgaccugcugcugggcgaccagagcuggagcuacaucguggagagacccaccgcccagaacggcaucugcuaccccggcgcccugaacgagguggaggagcugaaggcccugaucggcagcggcgagagaguggagagauucgagauguuccccaagagcaccuggaccggcguggacaccagcagcggcgugaccaaggccugccccuacaacagcggcagcagcuucuacagaaaccugcuguggaucaucaagaccaagagcgccgccuaccccgugaucaagggcaccuacaacaacaccggcagccagcccauccuguacuucuggggcgugcaccacccccccgacaccaacgagcagaacacccuguacggcagcggcgacagauacgugagaaugggcaccgagagcaugaacuucgccaagagccccgagaucgccgccagacccgccgugaacggccagagaggcagaaucgacuacuacuggagcgugcugaagcccggcgagacccugaacguggagagcaacggcaaccugaucgcccccugguacgccuacaaguucgugagcaccaacaacaagggcgccaucuucaagagcaaccugcccaucgagaacugcgacgccaccugccagaccaucgccggcgugcugagaaccaacaagaccuuccagaacgugagcccccuguggaucggcgagugccccaaguacgugaagagcgagagccugagacuggccaccggccugagaaacgugccccagaucgagaccagaggccuguucggcgccaucgccggcuucaucgagggcggcuggaccggcaugaucgacggcugguacggcuaccaccacgagaacagccagggcagcggcuacgccgccgacaaggagagcacccagaaggccaucgacggcaucaccaacaaggugaacagcaucaucgacaagaugaacacccaguucgaggccguggaccacgaguucagcaaccuggagagaagaaucgacaaccugaacaagagaauggaggacggcuuccuggacguguggaccuacaacgccgagcugcuggugcugcuggagaacgagagaacccuggaccugcacgacgccaacgugaagaaccuguacgagaaggugaagagccagcugagagacaacgccaacgaccugggcaacggcugcuucgaguucuggcacaagugcgacaacgagugcaucgagagcgugaagaacggcaccuacgacuaccccaaguaccaggacgagagcaagcugaacagacaggagaucgagagcgugaagcuggacaaccugggcguguaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36049 - RNA, 1701 nt, Artificial Sequence; identical to SEQ ID NO: 36048
  derived and/or modified sequence opt4 from anti-influenza_Chain

SEQ ID NO: 36050 - RNA, 1704 nt, Artificial Sequence
  derived and/or modified sequence opt4 from anti-influenza_Chain
gaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaaggacagcuggagcgaccacgaggccagccugggcgugagcagcgccugccccuaccagggcaacagcagcuucuucagaaacgugguguggcugaucaagaagggcaacgccuaccccaccaucaagaagagcuacaacaacaccaaccaggaggaccugcuggugcuguggggcauccaccaccccaacgacgaggccgagcagaccagacuguaccagaaccccaccaccuacaucagcaucggcaccagcacccugaaccagagacuggugcccaagaucgccaccagaagcaaggugaacggccagagcggcagaaucgacuucuucuggaccauccugaagcccaacgacgccaucaacuucgagagcaacggcaacuucaucgcccccgaguacgccuacaagaucgugaagaagggcgacagcaccaucaugaagagcgagguggaguacggcaacugcaacaccagaugccagacccccaugggcgccaucaacagcagcaugcccuuccacaacauccacccccugaccaucggcgagugccccaaguacgugaagagcaacaagcuggugcuggccaccggccugagaaacagcccccagagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36051 - RNA, 1704 nt, Artificial Sequence
  derived and/or modified sequence opt4 from anti-influenza_Chain
gaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucgugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36052 - RNA, 1704 nt, Artificial Sequence; identical to SEQ ID NO: 36050
  derived and/or modified sequence opt4 from anti-influenza_Chain

SEQ ID NO: 36053 - RNA, 1704 nt, Artificial Sequence; identical to SEQ ID NO: 36051
  derived and/or modified sequence opt4 from anti-influenza_Chain

SEQ ID NO: 36054 - RNA, 1707 nt, Artificial Sequence
  derived and/or modified sequence opt4 from anti-influenza_Chain
gaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36055 - RNA, 1707 nt, Artificial Sequence
  derived and/or modified sequence opt4 from anti-influenza_Chain
gaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36056 - RNA, 1707 nt, Artificial Sequence
  derived and/or modified sequence opt4 from anti-influenza_Chain
gaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugagcgaguggagcuacaucguggagaagaucaaccccgccaacgaccugugcuaccccggcaacuucaacaacuacgaggagcugaagcaccugcugagcagaaucaacagauucgagaagauccagaucauccccaagagcagcuggcccgaccacgaggccagccugggcgugagcagcgccugccccuaccagggcggccccagcuucuacagaaacgugguguggcugaucaagaagaacaacaccuaccccaccaucaagaagagcuaccacaacaccaaccaggaggaccugcuggugcuguggggcauccaccaccccaacgacgaggccgagcagaccagaaucuacaagaaccccaccaccuacaucagcgugggcaccagcacccugaaccagagacuggugcccaagaucgccaccagaagcaaggugaacggccagagcggcagaguggaguucuucuggaccauccugaagagcaacgacaccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36057 - RNA, 1707 nt, Artificial Sequence; identical to SEQ ID NO: 36054
  derived and/or modified sequence opt4 from anti-influenza_Chain

SEQ ID NO: 36058 - RNA, 1707 nt, Artificial Sequence; identical to SEQ ID NO: 36055
  derived and/or modified sequence opt4 from anti-influenza_Chain

SEQ ID NO: 36059 - RNA, 1707 nt, Artificial Sequence; identical to SEQ ID NO: 36056
  derived and/or modified sequence opt4 from anti-influenza_Chain

SEQ ID NO: 36060 - RNA, 1728 nt, Artificial Sequence
  derived and/or modified sequence opt4 from anti-influenza_Chain
aucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagaacggcagaauggacuucuucuggaccauccugaagcccaacgacgccaucaacuucgagagcaacggcaacuucaucgcccccgaguacgccuacaagaucgugaagaagggcgacagcgccaucgugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugggcuacauccccgaggcccccagagacggccaggccuacgugagaaaggacggcgagugggugcugcugagcaccuuccugagaagcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 36061 - RNA, 1728 nt, Artificial Sequence
  derived and/or modified sequence opt4 from anti-influenza_Chain
augguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcaagagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcuuccacagc

SEQ ID NO: 36062 - RNA, 1728 nt, Artificial Sequence; identical to SEQ ID NO: 36061
  derived and/or modified sequence opt4 from anti-influenza_Chain

SEQ ID NO: 36063 - RNA, 1728 nt, Artificial Sequence; identical to SEQ ID NO: 36060
  derived and/or modified sequence opt4 from anti-influenza_Chain

SEQ ID NO: 36064 - RNA, 1731 nt, Artificial Sequence
  derived and/or modified sequence opt4 from anti-influenza_Chain
gccaaggccggcgugcagagcgugaagauggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggcccugaugguggccggccugagccuguggaugugcagcaacggcagccugcagugcagaaucugcauc

SEQ ID NO: 36065 - RNA, 1731 nt, Artificial Sequence; identical to SEQ ID NO: 36064
  derived and/or modified sequence opt4 from anti-influenza_Chain

SEQ ID NO: 36066 - RNA, 1737 nt, Artificial Sequence
  derived and/or modified sequence opt4 from anti-influenza_Chain
augguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcacccagaccagaggcaagcugugccccaacugccugaacugcaccgaccuggacguggcccugggcagacccaagugcaugggcaccauccccagcgccaaggccagcauccugcacgaggugaagcccgugaccagcggcugcuuccccaucaugcacgacagaaccaagaucagacagcugcccaaccugcugagaggcuacgagaacaucagacugagcgccagaaacgugaucaacgccgagaccgcccccggcggccccuacaucgugggcaccagcggcagcugccccaacgugaccaacggcaagggcuucuucgccaccauggccugggccgugcccaagaacaagaacaagaccgccaccaacccccugaccguggaggugcccuacaucugcaccaagggcgaggaccagaucaccguguggggcuuccacagcgacaacgaggcccagauggugacccuguacggcgacagcaagccccagaaguucaccagcagcgccaacggcgugaccacccacuacgugagccagaucggcggcuuccccaaccagaccgaggacgagggccugcagcagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacguguuccugcugcaccugagcaucagaaag

SEQ ID NO: 36067 - RNA, 1737 nt, Artificial Sequence; identical to SEQ ID NO: 36066
  derived and/or modified sequence opt4 from anti-influenza_Chain

SEQ ID NO: 36068 - RNA, 1731 nt, Artificial Sequence
  derived and/or modified sequence opt4 from anti-influenza_Chain
auggagaccaucagccugaucaccauccugcugguggugaccgccagcaacgccgacaagaucugcaucggccaccagagcaccaacagcaccgagaccguggacacccugaccgagaccaacgugcccgugacccacgccaaggagcugcugcacaccgagcacaacggcaugcugugcgccaccagccugggccacccccugauccuggacaccugcaccaucgagggccugguguacggcaaccccagcugcgaccugcugcugggcggcagagaguggagcuacaucguggagagaagcagcgccgugaacggcaccugcuaccccggcaacguggagaaccuggaggagcugagaacccuguucagcagcgccagcagcuaccagagaauccagaucuuccccgacaccaccuggaacgugaccuacaccggcaccagcagagccugcagcggcagcuucuacagaagcaugagauggcugacccagaagagcggcuucuaccccgugcaggacgcccaguacaccaacaacagaggcaagagcauccuguucguguggggcauccaccacccccccaccuacaccgagcagaccaaccuguacaucagaaacgacaccaccaccagcgugaccaccgaggaccugaacagaaccuucaagcccgugaucggccccagaccccuggugaacggccugcagggcagaaucgacuacuacuggagcgugcugaagcccggccagacccugagagugagaagcaacggcaaccugaucgcccccugguacggccacgugcugagcggcggcagccacggcagaauccugaagaccgaccugaagggcggcaacugcguggugcagugccagaccgagaagggcggccugaacagcacccugcccuuccacaacaucagcaaguacgccuucggcaccugccccaaguacgugagagugaacagccugaagcuggccgugggccugagaaacgugcccgccagaagcagcagaggccuguucggcgccaucgccggcuucaucgagggcggcuggcccggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacgugugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacaacagaagaaaguacagagaggagagcagacuggagagacagaagaucgagggcgugaagcuggagagcgagggcaccuacaagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36069 - RNA, 1731 nt, Artificial Sequence; identical to SEQ ID NO: 36068
  derived and/or modified sequence opt4 from anti-influenza_Chain

SEQ ID NO: 36070 - RNA, 1752 nt, Artificial Sequence
  derived and/or modified sequence opt4 from anti-influenza_Chain
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcacccagaccagaggcaagcugugccccaacugcuucaacugcaccgaccuggacguggcccugggcagacccaagugcaugggcaacacccccagcgccaaggugagcauccugcacgaggugaagcccgccaccagcggcugcuuccccaucaugcacgacagaaccaagaucagacagcugcccaaccugcugagaggcuacgagaacaucagacugagcaccagcaacgugaucaacaccgagaccgcccccggcggccccuacaaggugggcaccagcggcagcugccccaacguggccaacggcaacggcuucuucaacaccauggccugggugauccccaaggacaacaacaagaccgccaucaaccccgugaccguggaggugcccuacaucugcagcgagggcgaggaccagaucaccguguggggcuuccacagcgacgacaagacccagauggagagacuguacggcgacagcaacccccagaaguucaccagcagcgccaacggcgugaccacccacuacgugagccagaucggcggcuuccccaaccagaccgaggacgagggccugaagcagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacuaccugagcgagcuggaggugaagaaccugcagagacugagcggcgccaugaacgagcugcacgacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgacuucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccug

SEQ ID NO: 36071 - RNA, 1752 nt, Artificial Sequence
  derived and/or modified sequence opt4 from anti-influenza_Chain
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccug

SEQ ID NO: 36072 - RNA, 1752 nt, Artificial Sequence
  derived and/or modified sequence opt4 from anti-influenza_Chain
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugaagcccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacgacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccug

SEQ ID NO: 36073 - RNA, 1752 nt, Artificial Sequence; identical to SEQ ID NO: 36070
  derived and/or modified sequence opt4 from anti-influenza_Chain

SEQ ID NO: 36074 - RNA, 1752 nt, Artificial Sequence; identical to SEQ ID NO: 36071
  derived and/or modified sequence opt4 from anti-influenza_Chain

SEQ ID NO: 36075 - RNA, 1752 nt, Artificial Sequence; identical to SEQ ID NO: 36072
  derived and/or modified sequence opt4 from anti-influenza_Chain

SEQ ID NO: 36076 - RNA, 1758 nt, Artificial Sequence
  derived and/or modified sequence opt4 from anti-influenza_Chain
augaaggccaucaucgugcugcugaugguggugaccagcaacgccgacagaaucaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccug

SEQ ID NO: 36077 - RNA, 1758 nt, Artificial Sequence; identical to SEQ ID NO: 36076
  derived and/or modified sequence opt4 from anti-influenza_Chain

SEQ ID NO: 36078 - RNA, 1749 nt, Artificial Sequence
  derived and/or modified sequence opt4 from anti-influenza_Chain
auggaggccagacugcuggugcugcugugcgccuucgccgccaccaacgccgacaccaucugcaucggcuaccacgccaacaacagcaccgacaccguggacaccgugcuggagaagaacgugaccgugacccacagcgugaaccugcuggaggacagccacaacggcaagcugugcaagcugaagggcaucgccccccugcagcugggcaagugcaacaucgccggcuggcugcugggcaaccccgagugcgaccugcugcugaccgccagcagcuggagcuacaucguggagaccagcaacagcgagaacggcaccugcuaccccggcgacuucaucgacuacgaggagcugagagagcagcugagcagcgugagcagcuucgagaaguucgagaucuuccccaagaccagcagcuggcccaaccacgagaccaccaagggcgugaccgccgccugcagcuacgccggcgccagcagcuucuacagaaaccugcuguggcugaccaagaagggcagcagcuaccccaagcugagcaagagcuacgugaacaacaagggcaaggaggugcuggugcuguggggcgugcaccacccccccaccggcaccgaccagcagagccuguaccagaacgccgacgccuacgugagcgugggcagcagcaaguacaacagaagauucacccccgagaucgccgccagacccaaggugagagaccaggccggcagaaugaacuacuacuggacccugcuggagcccggcgacaccaucaccuucgaggccaccggcaaccugaucgcccccugguacgccuucgcccugaacagaggcagcggcagcggcaucaucaccagcgacgcccccgugcacgacugcaacaccaagugccagaccccccacggcgccaucaacagcagccugcccuuccagaacauccaccccgugaccaucggcgagugccccaaguacgugagaagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaaccuggagagaagaaucgagaaccugaacaagaagguggacgacggcuuccuggacaucuggaccuacaacgccgagcugcuggugcugcuggagaacgagagaacccuggacuuccacgacagcaacgugagaaaccuguacgagaaggugaagagccagcugaagaacaacgccaaggagaucggcaacggcugcuucgaguucuaccacaagugcgacgacgccugcauggagagcgugagaaacggcaccuacgacuaccccaaguacagcgaggagagcaagcugaacagagaggagaucgacggcgugaagcuggagagcaugggcguguaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36079 - RNA, 1749 nt, Artificial Sequence; identical to SEQ ID NO: 36078
  derived and/or modified sequence opt4 from anti-influenza_Chain

SEQ ID NO: 36080 - RNA, 1755 nt, Artificial Sequence
  derived and/or modified sequence opt4 from anti-influenza_Chain
auggagagaaccgugcugcugcuggccaccgugagccuggugaagagcgaccagaucugcaucggcuaccacgccaacaacagcaccgagcagguggacaccaucauggagaagaacgugaccgugacccacgcccaggacauccuggagagaacccacaacggcaagcugugcgaccugaacggcgugaagccccugauccugagagacugcagcguggccggcuggcugcugggcaaccccaugugcgacgaguucaucaacgugcccgaguggagcuacaucguggagaaggccagccccgccaacgaccugugcuaccccggcaacuucaacgacuacgaggagcugaagcaccugcugagcagaaucaaccacuucgagaagauccagaucauccccaagagcagcuggagcaaccacgacgccagcagcggcgugagcagcgccugccccuaccugggcagaagcagcuucuucagaaacgugguguggcugaucaagaagaacagcgccuaccccaccaucaagagaagcuacaacaacaccaaccaggaggaccugcuggugcuguggggcgugcaccaccccaacgacgccgccgagcagaccaagcuguaccagaaccccaccaccuacaucagcgugggcaccagcacccugaaccagagacuggugcccgagaucgccaccagacccaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacaccccccagagagagagaagaagaaagaagagaggccuguucggcgccaucgccggcuucaucgagggcggcuggcagggcaugguggacggcugguacggcuaccaccacagcaacgagcagggcagcugcuacagcgccgacaaggagagcacccagaaggccaucgacggcgugaccaacaaggugaacagcaucaucaacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugaagaacggcaccuacgacuacccccaguacagcgaggaggccagacugaacagagaggagaucagcggcgugaagcuggagagcaugggcaccuaccagagcggcagacuggugcccagaggcagccccggcagcggcuacauccccgaggcccccagagacggccaggccuacgugagaaaggacggcgagugggugcugcugagcaccuuccugggcaagcccauccccaacccccugcugggccuggacagcaccggc

SEQ ID NO: 36081 - RNA, 1755 nt, Artificial Sequence; identical to SEQ ID NO: 36080
  derived and/or modified sequence opt4 from anti-influenza_Chain

SEQ ID NO: 36082 - RNA, 1947 nt, Artificial Sequence
  derived and/or modified sequence opt4 from anti-influenza_Chain
augggcgacaagaucaacuucaucuucggcauccacaaccaccagccccugggcaacuucggcuggguguucgaggaggccuacgagaagugcuacuggcccuuccuggagacccuggaggaguaccccaacaugaagguggccauccacaccagcggcccccugaucgaguggcugcaggacaacagacccgaguacaucgaccugcugagaagccuggugaagagaggccagguggagaucgugguggccggcuucuacgagcccgugcuggccagcauccccaaggaggacagaaucgagcagaucagacugaugaaggagugggccaagagcaucggcuucgacgccagaggcguguggcugaccgagagaguguggcagcccgagcuggugaagacccugaaggagagcggcaucgacuacgugaucguggacgacuaccacuucaugagcgccggccugagcaaggaggagcuguacuggcccuacuacaccgaggacggcggcgaggugaucgccguguuccccaucgacgagaagcugagauaccugauccccuucagacccguggacaaggugcuggaguaccugcacagccugaucgacggcgacgagagcaagguggccguguuccacgacgacggcgagaaguucggcaucuggcccggcaccuacgaguggguguacgagaagggcuggcugagagaguucuucgacagaaucagcagcgacgagaagaucaaccugaugcuguacaccgaguaccuggagaaguacaagcccagaggccugguguaccugcccaucgccagcuacuucgagaugagcgaguggagccugcccgccaagcaggccagacuguucguggaguucgugaacgagcugaaggugaagggcaucuucgagaaguacagaguguucgugagaggcggcaucuggaagaacuucuucuacaaguaccccgagagcaacuacaugcacaagagaaugcugauggugagcaagcuggugagaaacaaccccgaggccagaaaguaccugcugagagcccagugcaacgacgccuacuggcacggccuguucggcggcguguaccugccccaccugagaagagccaucuggaacaaccugaucaaggccaacagcuacgugagccugggcaaggugaucagagacaucgacuacgacggcuucgaggaggugcugaucgagaacgacaacuucuacgccguguucaagcccagcuacggcggcagccugguggaguucagcagcaagaacagacuggugaacuacguggacgugcuggccagaagaugggagcacuaccacggcuacguggagagccaguucgacggcguggccagcauccacgagcuggagaagaagauccccgacgagaucagaaaggagguggccuacgacaaguacagaagauucaugcugcaggaccacguggugccccugggcaccacccuggaggacuucauguucagcagacagcaggagaucggcgaguuccccagagugcccuacagcuacgagcugcuggacggcggcaucagacugaagagagagcaccugggcaucgagguggagaagaccgugaagcuggugaacgacggcuucgagguggaguacaucgugaacaacaagaccggcaaccccgugcuguucgccguggagcugaacguggccgugcagagcaucauggagagccccggcgugcugagaggcaaggagaucgugguggacgacaaguacgccgugggcaaguucgcccugaaguucgaggacgagauggagguguggaaguaccccgugaagacccugagccagagcgagagcggcugggaccugauccagcagggcgugagcuacaucgugcccaucagacuggaggacaagaucagauucaagcugaaguucgaggaggccagcggc

SEQ ID NO: 36083 - RNA, 1947 nt, Artificial Sequence
  derived and/or modified sequence opt4 from anti-influenza_Chain
augagcagaaugacccugaagagcagcaugaagaagagagugcugagccugcugaucgccgugguguuccugagccugaccggcguguuccccagcggccugaucgagaccaaggugagcgccgccaagaucaccgagaacuaccaguucgacagcagaaucagacugaacagcaucggcuucauccccaaccacagcaagaaggccaccaucgccgccaacugcagcaccuucuacguggugaaggaggacggcaccaucguguacaccggcaccgccaccagcauguucgacaacgacaccaaggagaccguguacaucgccgacuucagcagcgugaacgaggagggcaccuacuaccuggccgugcccggcgugggcaagagcgugaacuucaagaucgccaugaacguguacgaggacgccuucaagaccgccaugcugggcauguaccugcugagaugcggcaccagcgugagcgccaccuacaacggcauccacuacagccacggccccugccacaccaacgacgccuaccuggacuacaucaacggccagcacaccaagaaggacagcaccaagggcuggcacgacgccggcgacuacaacaaguacguggugaacgccggcaucaccgugggcagcauguuccuggccugggagcacuucaaggaccagcuggagcccguggcccuggagauccccgagaagaacaacagcauccccgacuuccuggacgagcugaaguacgagaucgacuggauccugaccaugcaguaccccgacggcagcggcagaguggcccacaaggugagcaccagaaacuucggcggcuucaucaugcccgagaacgagcacgacgagagauucuucgugcccuggagcagcgccgccaccgccgacuucguggccaugaccgccauggccgccagaaucuucagacccuacgacccccaguacgccgagaagugcaucaacgccgccaaggugagcuacgaguuccugaagaacaaccccgccaacguguucgccaaccagagcggcuucagcaccggcgaguacgccaccgugagcgacgccgacgacagacugugggccgccgccgagaugugggagacccugggcgacgaggaguaccugagagacuucgagaacagagccgcccaguucagcaagaagaucgaggccgacuucgacugggacaacguggccaaccugggcauguucaccuaccugcugagcgagagacccggcaagaaccccgcccuggugcagagcaucaaggacagccugcugagcaccgccgacagcaucgugagaaccagccagaaccacggcuacggcagaacccugggcaccaccuacuacuggggcugcaacggcaccguggugagacagaccaugauccugcagguggccaacaagaucagccccaacaacgacuacgugaacgccgcccuggacgccaucagccacguguucggcagaaacuacuacaacagaagcuacgugaccggccugggcaucaacccccccaugaacccccacgacagaagaagcggcgccgacggcaucugggagcccuggcccggcuaccuggugggcggcggcuggcccggccccaaggacuggguggacauccaggacagcuaccagaccaacgagaucgccaucaacuggaacgccgcccugaucuacgcccuggccggcuucgugaacuacaacagcccccagaacgaggugcuguacggcgacgugaacgacgacggcaaggugaacagcaccgaccugacccugcugaagagauacgugcugaaggccgugagcacccugcccagcagcaaggccgagaagaacgccgacgugaacagagacggcagagugaacagcagcgacgugaccauccugagcagauaccugaucagagugaucgagaagcugcccauc

SEQ ID NO: 36084 - RNA, 1947 nt, Artificial Sequence; identical to SEQ ID NO: 36082
  derived and/or modified sequence opt4 from anti-influenza_Chain

SEQ ID NO: 36085 - RNA, 1947 nt, Artificial Sequence; identical to SEQ ID NO: 36083
  derived and/or modified sequence opt4 from anti-influenza_Chain

SEQ ID NO: 36086 - RNA, 2046 nt, Artificial Sequence
  derived and/or modified sequence opt4 from anti-influenza_Chain
augaagcccagccacuucaccgagaagagauucaugaagaaggugcugggccuguuccuggugguggugaugcuggccagcgugggcgugcugcccaccagcaaggugcaggccgccggcaccaccgugaccagcauggaguacuucagccccgccgacggccccgugaucagcaagagcggcgugggcaaggccagcuacggcuucgugaugcccaaguucaacggcggcagcgccaccuggaacgacguguacagcgacgugggcgugaacgugaaggugggcaacaacuggguggacaucgaccaggccggcggcuacaucuacaaccagaacuggggccacuggagcgacggcggcuucaacggcuacugguucacccugagcgccaccaccgagauccagcuguacagcaaggccaacggcgugaagcuggaguaccagcugguguuccagaacaucaacaagaccaccaucaccgccaugaaccccacccagggcccccagaucaccgccagcuucaccggcggcgccggcuucaccuaccccaccuucaacaacgacagcgccgugaccuacgaggccguggccgacgaccugaagguguacgugaagcccgugaacagcagcagcuggaucgacaucgacaacaacgccgccagcggcuggaucuacgaccacaacuucggccaguucaccgacggcggcggcggcuacugguucaacgugaccgagagcaucaacgugaagcuggagagcaagaccagcagcgccaaccugguguacaccaucaccuucaacgagcccaccagaaacagcuacgugaucacccccuacgagggcaccaccuucaccgccgacgccaacggcagcaucggcaucccccugcccaagaucgacggcggcgcccccaucgccaaggagcugggcaacuucguguaccagaucaacaucaacggccaguggguggaccugagcaacagcagccagagcaaguucgccuacagcgccaacggcuacaacaacaugagcgacgccaaccaguggggcuacugggccgacuacaucuacggccugugguuccagcccauccaggagaacaugcagaucagaaucggcuacccccugaacggccaggccggcggcaacaucggcaacaacuucgugaacuacaccuucaucggcaaccccaacgcccccagacccgacgugagcgaccaggaggacaucagcaucggcacccccaccgaccccgccaucgccggcaugaaccugaucuggcaggacgaguucaacggcaccacccuggacaccagcaaguggaacuacgagaccggcuacuaccugaacaacgaccccgccaccuggggcuggggcaacgccgagcugcagcacuacaccaacagcacccagaacguguacgugcaggacggcaagcugaacaucaaggccaugaacgacagcaagagcuucccccaggaccccaacagauacgcccaguacagcagcggcaagaucaacaccaaggacaagcugagccugaaguacggcagaguggacuucagagccaagcugcccaccggcgacggcguguggcccgcccuguggaugcugcccaaggacagcguguacggcaccugggccgccagcggcgagaucgacgugauggaggccagaggcagacugcccggcagcgugagcggcaccauccacuucggcggccaguggcccgugaaccagagcagcggcggcgacuaccacuuccccgagggccagaccuucgccaacgacuaccacguguacagcguggugugggaggaggacaacaucaagugguacguggacggcaaguucuucuacaaggugaccaaccagcagugguacagcaccgccgcccccaacaaccccaacgcccccuucgacgagcccuucuaccugaucaugaaccuggccgugggcggcaacuucgacggcggcagaacccccaacgccagcgacauccccgccaccaugcagguggacuacgugagaguguacaaggagcag

SEQ ID NO: 36087 - RNA, 2046 nt, Artificial Sequence; identical to SEQ ID NO: 36086
  derived and/or modified sequence opt4 from anti-influenza_Chain

SEQ ID NO: 36088 - RNA, 2058 nt, Artificial Sequence
  derived and/or modified sequence opt4 from anti-influenza_Chain
augaccaagagcaucuacuucagccugggcauccacaaccaccagcccgugggcaacuucgacuucgugaucgagagagccuacgagaugagcuacaagccccugaucaacuucuucuucaagcaccccgacuuccccaucaacgugcacuucagcggcuuccugcugcuguggcuggagaagaaccaccccgaguacuucgagaagcugaagaucauggccgagagaggccagaucgaguucgugagcggcggcuucuacgagcccauccugcccaucauccccgacaaggacaaggugcagcagaucaagaagcugaacaaguacaucuacgacaaguucggccagacccccaagggcauguggcuggccgagagagugugggagccccaccuggugaaguacaucgccgaggccggcaucgaguacguggugguggacgacgcccacuucuucagcgugggccugaaggaggaggaccuguucggcuacuaccugauggaggagcagggcuacaagcuggccguguuccccaucagcaugaagcugagauaccugauccccuucgccgaccccgaggagaccaucaccuaccuggacaaguucgccagcgaggacaagagcaagaucgcccugcuguucgacgacggcgagaaguucggccuguggcccgacaccuacagaaccguguacgaggagggcuggcuggagaccuucgugagcaagaucaaggagaacuuccugcuggugacccccgugaaccuguacaccuacaugcagagagugaagcccaagggcagaaucuaccugcccaccgccagcuacagagagaugauggagugggugcuguuccccgaggcccagaaggagcuggaggagcugguggagaagcugaagaccgagaaccugugggacaaguucagccccuacgugaagggcggcuucuggagaaacuuccuggccaaguacgacgagagcaaccacaugcagaagaagaugcuguacguguggaagaaggugcaggacagccccaacgaggaggugaaggagaaggccauggaggagguguuccagggccaggccaacgacgccuacuggcacggcaucuucggcggccuguaccugccccaccugagaaccgccaucuacgagcaccugaucaaggccgagaacuaccuggagaacagcgagaucagauucaacaucuucgacuucgacugcgacggcaacgacgagaucaucguggagagccccuucuucaaccuguaccugagccccaaccacggcggcagcgugcuggagugggacuucaagaccaaggccuucaaccugaccaacgugcugaccagaagaaaggaggccuaccacagcaagcugagcuacgugaccagcgaggcccagggcaagagcauccacgagagauggaccgccaaggaggagggccuggagaacauccuguucuacgacaaccacagaagagugagcuucaccgagaagaucuucgagagcgagcccgugcuggaggaccuguggaaggacagcagcagacuggagguggacagcuucuacgagaacuacgacuacgagaucaacaaggacgagaacaagaucagagugcuguucagcggcguguucagaggcuucgagcugugcaagagcuacauccuguacaaggacaagagcuucguggacgugguguacgagaucaagaacgugagcgagacccccaucagccugaacuucggcugggagaucaaccugaacuuccuggcccccaaccaccccgacuacuacuuccugaucggcgaccagaaguacccccugagcagcuucggcaucgagaaggugaacaacuggaagaucuucagcggcaucggcaucgagcuggagugcgugcuggacguggaggccagccuguacagauaccccaucgagaccgugagccugagcgaggagggcuucgagagaguguaccagggcagcgcccugauccacuucuacaagguggaccugcccgugggcagcaccuggagaaccaccaucagauucugggugaag

SEQ ID NO: 36089 - RNA, 2058 nt, Artificial Sequence; identical to SEQ ID NO: 36088
  derived and/or modified sequence opt4 from anti-influenza_Chain

SEQ ID NO: 36090 - RNA, 2115 nt, Artificial Sequence
  derived and/or modified sequence opt4 from anti-influenza_Chain
augcccaccaaccuguucuucaacgcccaccacagccccgugggcgccuucgccagcuucacccugggcuuccccggcaagagcggcggccuggaccuggagcuggccagaccccccagacagaacgugcugaucggcguggagagccugcacgagagcggccuguaccacgugcugcccuuccuggagaccgccgaggaggacgagagcaagagauacgacaucgagaaccccgaccccaacccccagaagcccaacauccugauccccuucgccaaggaggagauccagagagaguuccacguggccaccgacaccuggaaggccggcgaccugaccuucaccaucuacagccccgugaaggccgugcccaaccccgagaccgccgacgaggaggagcugaagcuggcccuggugcccgccgugaucguggagaugaccaucgacaacaccaacggcaccagagccagaagagccuucuucggcuucgagggcaccgaccccuacaccagcaugagaagaaucgacgacaccugcccccagcugagaggcgugggccagggcagaauccugagcaucgugagcaaggacgagggcgugagaagcgcccugcacuucagcauggaggacauccugaccgcccagcuggaggagaacuggaccuucggccugggcaaggugggcgcccugaucguggacgugcccgccggcgagaagaagaccuaccaguucgccgugugcuucuacagaggcggcuacgugaccgccggcauggacgccagcuacuucuacaccagauucuuccagaacaucgaggaggugggccuguacgcccuggagcaggccgaggugcugaaggagcagagcuucagaagcaacaagcugaucgagaaggaguggcugagcgacgaccagaccuucaugauggcccacgccaucagaagcuacuacggcaacacccagcugcuggagcacgagggcaagcccaucuggguggugaacgagggcgaguacagaaugaugaacaccuucgaccugaccguggaccagcuguucuucgagcugaagcugaaccccuggaccgugaagaacgugcuggaccuguacguggagagauacagcuacgaggacagagugagauuccccggcgaggagaccgaguaccccagcggcaucagcuucacccacgacaugggcguggccaacaccuucagcagaccccacuacagcagcuacgagcuguacggcaucagcggcugcuucagccacaugacccacgagcagcuggugaacugggugcugugcgccgccguguacaucgagcagaccaaggacugggccuggagagacaagagacuggccauccuggagcagugccuggagagcauggugagaagagaccaccccgaccccgagcagagaaacggcgugaugggccuggacagcaccagaaccaugggcggcgccgagaucaccaccuacgacagccuggacgugagccugggccaggccagaaacaaccuguaccuggccggcaagugcugggccgccuacguggcccuggagaagcuguucagagacgugggcaaggaggagcuggccgcccuggccggcgagcaggccgagaagugcgccgccaccaucgugagccacgugaccgacgacggcuacauccccgccaucaugggcgagggcaacgacagcaagaucauccccgccaucgagggccugguguuccccuacuucaccaacugccacgaggcccuggacgagaacggcagauucggcgccuacauccaggcccugagaaaccaccugcaguacgugcugagagagggcaucugccuguuccccgacggcggcuggaagaucagcagcaccagcaacaacagcuggcugagcaagaucuaccugugccaguucaucgccagacacauccugggcugggagugggacgagcagggcaagagagccgacgccgcccacguggccuggcugacccaccccacccugagcaucuggagcuggagcgaccagaucaucgccggcgagaucaccggcagcaaguacuaccccagaggcgugaccagcauccuguggcuggaggagggcgag

SEQ ID NO: 36091 - RNA, 2115 nt, Artificial Sequence; identical to SEQ ID NO: 36090
  derived and/or modified sequence opt4 from anti-influenza_Chain

SEQ ID NO: 36092 - RNA, 2148 nt, Artificial Sequence
  derived and/or modified sequence opt4 from anti-influenza_Chain
auggaggacuucgugagacagugcuucaaccccaugaucguggagcuggccgagaaggccaugaaggaguacggcgaggaccugaagaucgagaccaacaaguucgccgccaucugcacccaccuggaggugugcuucauguacagcgacuuccacuucaucaacgagcagggcgagagcaucaucguggagcccgaggaccccaacgcccugcugaagcacagauucgagaucaucgagggcagagacagaaccauggccuggaccguggugaacagcaucugcaacaccaccggcgccgagaagcccaaguuccugcccgaccuguacgacuacaaggagaacagauucaucgagaucggcgugaccagaagagaggugcacaucuacuaccuggagaaggccaacaagaucaagagcgagaagacccacauccacaucuucagcuucaccggcgaggagauggccaccaaggccgacuacacccuggacgaggagagcagagccagaaucaagaccagacuguucaccaucagacaggagauggccagcagaggccugugggacagcuucagacagagcgagagaggcgaggagaccaucgaggagagauucgagaucaccggcaccaugagaagacuggccgaccagagccugccccccaacuucagcugccuggagaacuucagagccuacguggacggcuucgagcccaacggcuacaucgagggcaagcugagccagaugagcaaggaggugaacgccagaaucgagcccuuccugagaaccacccccagacccaucagacugcccgacggcccccccugcuuccagagaagcaaguuccugcugauggacagccugaagcugagcaucgaggaccccagccacgagggcgagggcaucccccuguacgacgccaucaagugcaugagaaccuucuucggcuggaaggagcccagcguggugaagccccacggcaagggcaucaaccccaacuaccugcugagcuggaagcaggugcuggccgagcugcaggacaucgagagcgaggagaagauccccagaaccaagaacaugaagaagaccagccagcugaagugggcccugggcgagaacauggcccccgagaagguggacuucgacgacugcaaggacaucagcgaccugaagcaguacgacagcgacgagcccgagcugagaagccugagcagcuggauccagaacgaguucaacaaggccugcgagcugaccgacagcaucuggaucgagcuggacgagaucggcgaggacguggcccccaucgagcacaucgccagcaugagaagaaacuacuucaccgccgaggugagccacugcagagccaccgaguacaucaugaagggcguguacaucaacaccgcccugcugaacgccagcugcgccgccauggacgacuuccagcugauccccaugaucagcaagugcagaaccaaggagggcagaagaaagaccaaccuguacggcuucaucaucaagggcagaagccaccugagaaacgacaccgacguggugaacuucgugagcauggaguucagccugaccgaccccagacuggagccccacaagugggagaaguacugcgugcuggagaucggcgacaugcugcugagaagcgccaucggccaggugagcagacccauguuccuguacgugagaaccaacggcaccagcaagaucaagaugaaguggggcauggagaugagaagaugccugcugcagagccugcagcagaucgagagcaugaucgaggccgagagcagcgugaaggagaaggacaugaccaaggaguucuucgagaacagaagcgagaccuggcccaucggcgagagccccaagggcguggaggagggcagcaucggcaaggugugcagaacccugcuggccaagagcguguucaacagccuguacgccagcccccagcuggagggcuucagcgccgagagcagaaagcugcugcugaucgugcaggcccugagagacaaccuggagcccggcaccuucgaccugggcggccuguacgaggccaucgaggagugccugaucaacgaccccugggugcugcugaacgccagcugguucaacagcuuccugacccacgcccugaga

SEQ ID NO: 36093 - RNA, 2148 nt, Artificial Sequence; identical to SEQ ID NO: 36092
  derived and/or modified sequence opt4 from anti-influenza_Chain

SEQ ID NO: 36094 - RNA, 2256 nt, Artificial Sequence
  derived and/or modified sequence opt4 from anti-influenza_Chain
augaacaucaaccccuacuuccuguucaucgacgugcccauccaggccgccaucagcaccaccuuccccuacaccggcgugccccccuacagccacggcaccggcaccggcuacaccaucgacaccgugaucagaacccacgaguacagcaacaagggcaagcaguacaucagcgacgugaccggcugcgugaugguggaccccaccaacggcccccugcccgaggacaacgagcccagcgccuacgcccagcuggacugcgugcuggaggcccuggacagaauggacgaggagcaccccggccuguuccaggccggcagccagaacgccauggaggcccugauggugaccaccguggacaagcugacccagggcagacagaccuucgacuggaccgugugcagaaaccagcccgccgccaccgcccugaacaccaccaucaccagcuucagacugaacgaccugaacggcgccgacaagggcggccuggugcccuucugccaggacaucaucgacagccuggacaagcccgagaugaucuucuucaccgugaagaacaucaagaagaagcugcccgccaagaacagaaagggcuuccugaucaagagaauccccaugaaggugaaggacagaaucaccagaguggaguacaucaagagagcccugagccugaacaccaugaccaaggacgccgagagaggcaagcugaagagaagagccaucgccaccgccggcauccagaucagaggcuucgugcuggugguggagaaccuggccaagaacaucugcgagaaccuggagcagagcggccugcccgugggcggcaacgagaagaaggccaagcugagcaacgccguggccaagaugcugagcaacugcccccccggcggcaucagcaugaccgugaccggcgacaacaccaaguggaacgagugccugaaccccagaaucuuccuggccaugaccgagagaaucaccagagacagccccaucugguucagagacuucugcagcaucgcccccgugcuguucagcaacaagaucgccagacugggcaagggcuucaugaucaccagcaagaccaagagacugaaggcccagauccccugccccgaccuguucaacaucccccuggagagauacaacgaggagaccagagccaagcugaagaagcugaagcccuucuucaacgaggagggcaccgccagccugagccccggcaugaugaugggcauguucaacaugcugagcaccgugcugggcguggccgcccugggcaucaagaacaucggcaacaaggaguaccugugggacggccugcagagcagcgacgacuucgcccuguucgugaacgccaaggacgaggagaccugcauggagggcaucaacgacuucuacagaaccugcaagcugcugggcaucaacaugagcaagaagaagagcuacugcaacgagaccggcauguucgaguucaccagcauguucuacagagacggcuucgugagcaacuucgccauggagcugcccagcuucggcguggccggcgugaacgagagcgccgacauggccaucggcaugaccaucaucaagaacaacaugaucaacaacggcaugggccccgccaccgcccagaccgccauccagcuguucaucgccgacuacagauacaccuacaagugccacagaggcgacagcaagguggagggcaagagaaugaagaucaucaaggagcugugggagaacaccaagggcagagacggccugcugguggccgacggcggccccaaccuguacaaccugagaaaccugcacauccccgagaucauccugaaguacaacaucauggaccccgaguacaagggcagacugcugcacccccagaaccccuucgugggccaccugagcaucgagggcaucaaggaggccgacaucacccccgcccacggccccaucaagaagauggacuacgacgccgugagcggcacccacagcuggagaaccaagagaaacagaagcauccugaacaccgaccagagaaacaugauccuggaggagcagugcuacgccaagugcugcaaccuguucgaggccugcuucaacagcgccagcuacagaaagcccgugggccagcacagcaugcuggaggccauggcccacagacugagaauggacgccagacuggacuacgagagcggcagaaugagcaaggaggacuucgagaaggccauggcccaccugggcgagaucggcuacaug

SEQ ID NO: 36095 - RNA, 2256 nt, Artificial Sequence; identical to SEQ ID NO: 36094
  derived and/or modified sequence opt4 from anti-influenza_Chain

SEQ ID NO: 36096 - RNA, 2265 nt, Artificial Sequence
  derived and/or modified sequence opt4 from anti-influenza_Chain
auggccguggacaucaagaagaucaucaagcagaugacccuggaggagaaggccggccugugcagcggccuggacuucuggcacaccaagcccguggagagacugggcauccccagcaucaugaugaccgacggcccccacggccugagaaagcagagagaggacgccgagaucgccgacaucaacaacagcgugcccgccaccugcuuccccagcgccgccggccuggccugcagcugggacagagagcugguggagagagugggcgccgcccugggcgaggagugccaggccgagaacgugagcauccugcugggccccggcgccaacaucaagagaagcccccugugcggcagaaacuucgaguacuucagcgaggaccccuaccugagcagcgagcuggccgccagccacaucaagggcgugcagagccagggcgugggcgccugccugaagcacuucgccgccaacaaccaggagcacagaagaaugaccguggacaccaucguggacgagagaacccugagagagaucuacuucgccagcuucgagaacgccgugaagaaggccagacccuggguggugaugugcgccuacaacaagcugaacggcgaguacugcagcgagaacagauaccugcugaccgaggugcugaagaacgaguggaugcacgacggcuucguggugagcgacuggggcgccgugaacgacagagugagcggccuggacgccggccuggaccuggagaugcccaccagccacggcaucaccgacaagaagaucguggaggccgugaagagcggcaagcugagcgagaacauccugaacagagccguggagagaauccugaaggugaucuucauggcccuggagaacaagaaggagaacgcccaguacgacaaggacgcccaccacagacuggccagacaggccgccgccgagagcauggugcugcugaagaacgaggacgacgugcugccccugaagaagagcggcaccaucgcccugaucggcgccuucgugaagaagcccagauaccagggcagcggcagcagccacaucacccccaccagacuggacgacaucuacgaggagaucaagaaggccggcggcgacaaggugaaccugguguacagcgagggcuacagacuggagaacgacggcaucgacgaggagcugaucaacgaggccaagaaggccgccagcagcagcgacguggccgugguguucgccggccugcccgacgaguacgagagcgagggcuucgacagaacccacaugagcauccccgagaaccagaacagacugaucgaggccguggccgaggugcagagcaacaucgugguggugcugcugaacggcagccccguggagaugcccuggaucgacaaggugaagagcgugcuggaggccuaccugggcggccaggcccugggcggcgcccuggccgacgugcuguucggcgaggugaaccccagcggcaagcuggccgagaccuuccccgugaagcugagccacaaccccagcuaccugaacuuccccggcgaggacgacagaguggaguacaaggagggccuguucgugggcuacagauacuacgacaccaagggcaucgagccccuguuccccuucggccacggccugagcuacaccaaguucgaguacagcgacaucagcguggacaagaaggacgugagcgacaacagcaucaucaacgugagcgugaaggugaagaacgugggcaagauggccggcaaggagaucgugcagcuguacgugaaggacgugaagagcagcgugagaagacccgagaaggagcugaagggcuucgagaagguguuccugaaccccggcgaggagaagaccgugaccuucacccuggacaagagagccuucgccuacuacaacacccagaucaaggacuggcacguggagagcggcgaguuccugauccugaucggcagaagcagcagagacaucgugcugaaggagagcgugagagugaacagcaccgugaagaucagaaagagauucaccgugaacagcgccguggaggacgugaugagcgacagcagcgccgccgccgugcugggccccgugcugaaggagaucaccgacgcccugcagaucgacauggacaacgcccacgacaugauggccgccaacaucaagaacaugccccugagaagccuggugggcuacagccagggcagacugagcgaggagaugcuggaggagcugguggacaagaucaacaacguggag

SEQ ID NO: 36097 - RNA, 2265 nt, Artificial Sequence; identical to SEQ ID NO: 36096
  derived and/or modified sequence opt4 from anti-influenza_Chain

SEQ ID NO: 36098 - RNA, 2277 nt, Artificial Sequence
  derived and/or modified sequence opt4 from anti-influenza_Chain
auggagagaaucaaggagcugagaaaccugaugagccagagcagaaccagagagauccugaccaagaccaccguggaccacauggccaucaucaagaaguacaccagcggcagacaggagaagaaccccgcccugagaaugaaguggaugauggccaugaaguaccccaucaccgccgacaagagaaucaccgagaugauccccgagagaaacgagcagggccagacccuguggagcaagaugaacgacgccggcagcgacagagugauggugagcccccuggccgugaccugguggaacagaaacggccccaugaccaacaccgugcacuaccccaagaucuacaagaccuacuucgagagaguggagagacugaagcacggcaccuucggccccgugcacuucagaaaccaggugaagaucagaagaagaguggacaucaaccccggccacgccgaccugagcgccaaggaggcccaggacgugaucauggaggugguguuccccaacgaggugggcgccagaauccugaccagcgagagccagcugaccaucaccaaggagaagaaggaggagcugcaggacugcaagaucagcccccugaugguggccuacaugcuggagagagagcuggugagaaagaccagauuccugcccguggccggcggcaccagcagcguguacaucgaggugcugcaccugacccagggcaccugcugggagcagauguacacccccggcggcgaggugaagaacgacgacguggaccagagccugaucaucgccgccagaaacaucgugagaagagccgccgugagcgccgacccccuggccagccugcuggagaugugccacagcacccagaucggcggcaucagaaugguggacauccugaagcagaaccccaccgaggagcaggccgugggcaucugcaaggccgccaugggccugagaaucagcagcagcuucagcuucggcggcuucaccuucaagagaaccagcggcagcagcgugaagagagaggaggaggugcugaccggcaaccugcagacccugaagaucagagugcacgagggcuacgaggaguucaccauggugggcagaagagccaccgccauccugagaaaggccaccagaagacugauccagcugaucgugagcggcagagacgagcagagcaucgccgaggccaucaucguggccaugguguucagccaggaggacugcaugaucaaggccgugagaggcgaccugaacuucgugaacagagccaaccagagacugaaccccaugcaccagcugcugagacacuuccagaaggacgccaaggugcuguuccagaacuggggcguggagcccaucgacaacgugaugggcaugaucggcauccugcccgacaugacccccagcaucgagaugagcaugagaggcgugagaaucagcaagaugggcguggacgaguacagcagcaccgagagagugguggugagcaucgacagauuccugagagugagagaccagagaggcaacgugcugcugagccccgaggaggugagcgagacccagggcaccgagaagcugaccaucaccuacagcagcagcaugaugugggagaucaacggccccgagagcgugcuggugaacaccuaccaguggaucaucagaaacugggagaccgugaagauccaguggagccagaaccccaccaugcuguacaacaagauggaguucgagcccuuccagagccuggugcccaaggccaucagaggccaguacagcggcuucgugagaacccuguuccagcagaugagagacgugcugggcaccuucgacaccgcccagaucaucaagcugcugcccuucgccgccgccccccccaagcagagcagaaugcaguucagcagcuucaccgugaacgugagaggcagcggcaugagaauccuggugagaggcaacagccccguguucaacuacaacaaggccaccaagagacugaccgugcugggcaaggacgccggcacccugaccgaggaccccgacgagggcaccgccggcguggagagcgccgugcugagaggcuuccugauccugggcaaggaggacagaagauacggccccgcccugagcaucaacgagcugagcaaccuggccaagggcgagaaggccaacgugcugaucggccagggcgacguggugcuggugaugaagagaaagagagacagcagcauccugaccgacagccagaccgccaccaagagaaucagaauggccaucaac

SEQ ID NO: 36099 - RNA, 2277 nt, Artificial Sequence; identical to SEQ ID NO: 36098
  derived and/or modified sequence opt4 from anti-influenza_Chain

SEQ ID NO: 36100 - RNA, 2472 nt, Artificial Sequence
  derived and/or modified sequence opt4 from anti-influenza_Chain
augaugcugagaaagaagaccaagcagcugaucagcagcauccugauccuggugcugcugcugagccuguuccccgccgcccuggccgccgagggcaacaccagagaggacaacuucaagcaccugcugggcaacgacaacgugaagagacccagcgaggccggcgcccugcagcugcaggagguggacggccagaugacccugguggaccagcacggcgagaagauccagcugagaggcaugagcacccacggccugcagugguuccccgagauccugaacgacaacgccuacaaggcccugagcaacgacugggacagcaacaugaucagacuggccauguacgugggcgagaacggcuacgccaccaaccccgagcugaucaagcagagagugaucgacggcaucgagcuggccaucgagaacgacauguacgugaucguggacuggcacgugcacgcccccggcgaccccagagaccccguguacgccggcgccaaggacuucuucagagagaucgccgcccuguaccccaacaacccccacaucaucuacgagcuggccaacgagcccagcagcaacaacaacggcggcgccggcauccccaacaacgaggagggcuggaaggccgugaaggaguacgccgaccccaucguggagaugcugagaaagagcggcaacgccgacgacaacaucaucaucgugggcagccccaacuggagccagagacccgaccuggccgccgacaaccccaucgacgaccaccacaccauguacaccgugcacuucuacaccggcagccacgccgccagcaccgagagcuaccccagcgagacccccaacagcgagagaggcaacgugaugagcaacaccagauacgcccuggagaacggcguggccguguucgccaccgaguggggcaccagccaggccagcggcgacggcggccccuacuucgacgaggccgacguguggaucgaguuccugaacgagaacaacaucagcugggccaacuggagccugaccaacaagaacgaggugagcggcgccuucacccccuucgagcugggcaagagcaacgccaccaaccuggaccccggccccgaccacgugugggcccccgaggagcugagccugagcggcgaguacgugagagccagaaucaagggcgugaacuacgagcccaucgacagaaccaaguacaccaaggugcugugggacuucaacgacggcaccaagcagggcuucggcgugaacagcgacagccccaacaaggagcugaucgccguggacaacgagaacaacacccugaaggugagcggccuggacgugagcaacgacgugagcgacggcaacuucugggccaacgccagacugagcgccaacggcuggggcaagagcguggacauccugggcgccgagaagcugaccauggacgugaucguggacgagcccaccaccguggccaucgccgccaucccccagagcagcaagagcggcugggccaaccccgagagagccgugagagugaacgccgaggacuucgugcagcagaccgacggcaaguacaaggccggccugaccaucaccggcgaggacgcccccaaccugaagaacaucgccuuccacgaggaggacaacaacaugaacaacaucauccuguucgugggcaccgacgccgccgacgugaucuaccuggacaacaucaaggugaucggcaccgagguggagauccccguggugcacgaccccaagggcgaggccgugcugcccagcguguucgaggacggcaccagacagggcugggacugggccggcgagagcggcgugaagaccgcccugaccaucgaggaggccaacggcagcaacgcccugagcugggaguucggcuaccccgaggugaagcccagcgacaacugggccaccgcccccagacuggacuucuggaagagcgaccuggugagaggcgagaacgacuacguggccuucgacuucuaccuggaccccgugagagccaccgagggcgccaugaacaucaaccugguguuccagccccccaccaacggcuacugggugcaggcccccaagaccuacaccaucaacuucgacgagcuggaggaggccaaccaggugaacggccuguaccacuacgaggugaagaucaacgugagagacaucaccaacauccaggacgacacccugcugagaaacaugaugaucaucuucgccgacguggagagcgacuucgccggcagaguguucguggacaacgugagauucgagggcgccgccaccaccgagcccguggagcccgagcccguggaccccggcgaggagaccccccccguggacgagaaggaggccaagaaggagcagaaggaggccgagaaggaggagaaggaggccgugaaggaggagaagaaggaggccaaggaggagaagaaggccgugaagaacgaggccaagaagaag

SEQ ID NO: 36101 - RNA, 2472 nt, Artificial Sequence; identical to SEQ ID NO: 36100
  derived and/or modified sequence opt4 from anti-influenza_Chain

SEQ ID NO: 36102 - RNA, 3063 nt, Artificial Sequence
  derived and/or modified sequence opt4 from anti-influenza_Chain
auggccggcccccacagaagcagagccgccggccccccccccuucgccguggacgagcacguggcccuggagaugguggccuucagaggcgagguguucgccggccacggccugcuggccgaccagagacugaucgcccacaccggcagacccgcccugaacgcccagagaaucacccagcagaagcagagagaccagugcagaggccagagacacagacaccaccagggcggcagaaaccugagaaaggcccacagaaccuuccacgagcaccagagcacccaggaccaggcccacgacgccccccacggccagcaggccaagaccggccacgagggccugggccacgagcacgcccaggcccagcaccagcagggccagagcaacgugguggacagacaggacggcgagcccguggaggcccagcaccagaaggacggcgcccagagagccggcaacgcccccgccggcagaguggagcuggagcagcagcccguggaggcccagcaccagcagcaggagggcgacgugagaaucggcaagagaagacagaacgccuucgccccccccgcccuggaccacgugcacggcggccccggcagacugcagagacacggccuggccguggagagacacgugcccgccgugcagcagcaccagcagagagugcagagaggcagacagcagaucgaccacgugcugggccacggccugcccggcagacagagacuggccuucagagacggccccagaagacccgugggcguggccagccccgugcugggccagagacccugccccggccacagaaucgugcagaaccuguucagacacggcaucgaccccugcagagugggcagaugcagaagaagccccagcgagcugcacggcaugggcugcgccgacgugagagccagaggccacggcagacacaugagaggccagagagacgagcaccccggcagaggcagacccugcgccagaagaagacacguggacgacgacagagacagaaccccccaggagaagcuguacgacguggccagaggccuggacgagcccgccagaagagugcacuucgacgacgaggccgacagaagcguguucagaggccuggcccagcccgcccccgacgagcccgagggcagaagaagagacagacuggugcugcagagacagagcgugaaccacagaagaggcagacugagcagacacagacagcagcaccagccccagcagcagagaccccacggcaaccaggccuuccugggcaaguacgagaagagaagaagaaagcccaccgccugccugaagagccugagaagauuccccgacaaggacgcccccgugcuguacuucgugaaccagcuggagaagaccaagagaagaaugacccugcugcugguguggcugaucuucaccggcguggccggcgagaucagacuggaggccgaggacggcgagcugcugggcguggccguggacagcacccugaccggcuacagcggcagaggcuacgugaccggcuucgacgcccccgaggacagcgugagauucagcuucgaggcccccagaggcguguacagagugguguucggcgugagcuucagcagcagauucgccagcuacgcccugagaguggacgacuggcaccagaccggcagccugaucaagagaggcggcggcuucuucgaggccagcaucggcgagaucuggcuggacgagggcgcccacaccauggccuuccagcugaugaacggcgcccuggacuacgugagacuggagcccgugagcuacggcccccccgccagaccccccgcccagcugagcgacagccaggccaccgccagcgcccaggcccuguucgccuuccugcugagcgaguacggcagacacauccuggccggccagcagcagaaccccuacagaagagacuucgacgccaucaacuacgugagaaacgugaccggcaaggagcccgcccuggugagcuucgaccugaucgacuacagccccaccagagaggcccacggcguggugcacuaccagacccccgaggacuggaucgccugggccggcagagacggcaucgugagccugauguggcacuggaacgcccccaccgaccugaucgaggaccccagccaggacugcuacuggugguacggcuucuacaccagaugcaccaccuucgacguggccgccgcccuggccgacaccagcagcgagagauacagacugcugcugagagacaucgacgugaucgccgcccagcugcagaaguuccagcaggccgacauccccgugcuguggagaccccugcacgaggccgccggcggcugguucugguggggcgccaagggccccgagcccuucaagcagcuguggagacugcuguacgagagacuggugcaccaccacggccugcacaaccugaucuggguguacacccacgagcccggcgccgccgagugguaccccggcgacgccuacguggacaucgugggcagagacguguacgccgacgaccccgacgcccugaugagaagcgacuggaacgagcugcagacccuguucggcggcagaaagcugguggcccugaccgagaccggcacccugcccgacguggaggugaucaccgacuacggcaucugguggagcugguucagcaucuggaccgaccccuuccugagagacguggaccccgacagacugaccagaguguaccacagcgagagagugcugaccagagacgagcugcccgacuggagaagcuacgugcugcacgccaccaccgugcagcccgccggcgaccuggcccuggccguguaccccaaccccggcgccggcagacugcacguggaggugggccugcccguggccgcccccguggugguggagguguucaaccugcugggccagagaguguuccaguaccaggccggcaugcagcccgccggccuguggagaagagccuucgagcuggcccuggcccccggcguguaccuggugcaggugagagccggcaaccugguggccagaagaagaugggugagcgugaga

SEQ ID NO: 36103 - RNA, 3063 nt, Artificial Sequence; identical to SEQ ID NO: 36102
  derived and/or modified sequence opt4 from anti-influenza_Chain

SEQ ID NO: 36104 - RNA, 3165 nt, Artificial Sequence
  derived and/or modified sequence opt4 from anti-influenza_Chain
augagaaagaagagaagaggcuuccugaacgccagcaccgccgugcuggugggcauccuggccggcuuccugggcguggugcuggccgccaccggcgcccugggcuucgccgugagagagagccugcugcugaagcaguuccuguuccugagcuucgagggcaacaccgacggcgccagccccuucggcaaggacgugguggugaccgccagccaggacguggccgccgacggcgaguacagccugaagguggagaacagaaccagcgugugggacggcguggagaucgaccugaccggcaaggugaacaccggcaccgacuaccugcugagcuuccacguguaccagaccagcgacagcccccagcuguucagcgugcuggccagaaccgaggacgagaagggcgagagauacaagauccuggccgacaaggugguggugcccaacuacuggaaggagauccuggugcccuucagccccaccuucgagggcacccccgccaaguucagccugaucaucaccagccccaagaagaccgacuucguguucuacguggacaacgugcaggugcugacccccaaggaggccggccccaaggugguguacgagaccagcuucgagaagggcaucggcgacuggcagcccagaggcagcgacgugaagaucagcaucagccccaagguggcccacagcggcaagaagagccuguucgugagcaacagacagaagggcuggcacggcgcccagaucagccugaagggcauccugaagaccggcaagaccuacgccuucgaggccuggguguaccaggagagcggccaggaccagaccaucaucaugaccaugcagagaaaguacagcagcgacagcagcaccaaguacgaguggaucaaggccgccaccgugcccagcggccagugggugcagcugagcggcaccuacaccauccccgccggcgugaccguggaggaccugacccuguacuucgagagccagaaccccacccuggaguucuacguggacgacgugaaggugguggacaccaccagcgccgagaucaagcuggagaugaaccccgaggaggagauccccgcccugaaggacgugcugaaggacuacuucagagugggcguggcccugcccagcaagguguucaucaaccagaaggacaucgcccugaucagcaagcacagcaacagcagcaccgccgagaacgagaugaagcccgacagccugcuggccggcaucgagaacggcaagcugaaguucagauucgagaccgccgacaaguacaucgaguucgcccagcagaacggcaugguggugagaggccacacccugguguggcacaaccagacccccgagugguucuucaaggacgagaacggcaaccugcugagcaaggaggagaugaccgagagacugagagaguacauccacaccguggugggccacuucaagggcaagguguacgccugggacguggugaacgaggccguggaccccaaccagcccgacggccugagaagaagcaccugguaccagaucaugggccccgacuacaucgagcuggccuucaaguucgccagagaggccgaccccaacgccaagcuguucuacaacgacuacaacaccuucgagcccaagaagagagacaucaucuacaaccuggugaagagccugaaggagaagggccugaucgacggcaucggcaugcagugccacaucagccuggccaccgacaucagacagaucgaggaggccaucaagaaguucagcaccauccccggcaucgagauccacaucaccgagcuggacaucagcguguacagagacagcaccagcaacuacagcgaggcccccagaaccgcccugaucgagcaggcccacaagauggcccagcuguucaagaucuucaagaaguacagcaacgugaucaccaacgugaccuucuggggccugaaggacgacuacagcuggagagccaccagaagaaacgacuggccccugaucuucgacaaggacuaccaggccaagcuggccuacugggccaucguggcccccgaggugcugcccccccugcccaaggagagcaagaucagcgagggcgaggccgugguggugggcaugauggacgacagcuacaugaugagcaagcccaucgagaucuacgacgaggagggcaacgugaaggccaccaucagagccaucuggaaggacagcaccaucuacguguacggcgaggugcaggacgccaccaagaagcccgccgaggacggcguggccaucuucaucaaccccaacaacgagagaacccccuaccugcagcccgacgacaccuacguggugcuguggaccaacuggaagagcgaggugaacagagaggacguggaggugaagaaguucgugggccccggcuucagaagauacagcuucgagaugagcaucaccauccccggcguggaguucaagaaggacagcuacaucggcuucgacguggccgugaucgacgacggcaagugguacagcuggagcgacaccaccaacagccagaagaccaacaccaugaacuacggcacccugaagcuggagggcgugaugguggccaccgccaaguacggcacccccgugaucgacggcgagaucgacgacaucuggaacaccaccgaggagaucgagaccaagagcguggccaugggcagccuggagaagaacgccaccgccaaggugagagugcugugggacgaggagaaccuguacgugcuggccaucgugaaggaccccgugcugaacaaggacaacagcaaccccugggagcaggacagcguggagaucuucaucgacgagaacaaccacaagaccggcuacuacgaggacgacgacgcccaguucagagugaacuacaugaacgagcagagcuucggcaccggcgccagcgccgccagauucaagaccgccgugaagcugaucgagggcggcuacaucguggaggccgccaucaaguggaagaccaucaagcccagccccaacaccgugaucggcuucaacgugcaggugaacgacgccaacgagaagggccagagagugggcaucaucagcuggagcgaccccaccaacaacagcuggagagaccccagcaaguucggcaaccugagacugaucaag

SEQ ID NO: 36105 - RNA, 3165 nt, Artificial Sequence; identical to SEQ ID NO: 36104
  derived and/or modified sequence opt4 from anti-influenza_Chain

SEQ ID NO: 36106 - RNA, 3177 nt, Artificial Sequence
  derived and/or modified sequence opt4 from anti-influenza_Chain
augcaggugagaaagagaagaggccugcuggacgugagcaccgccgugcuggugggcauccuggccggcuuccugggcguggugcuggccgccagcggcgugcugagcuucggcaaggaggccagcagcaagggcgacagcagccuggagaccgugcuggcccugagcuucgagggcaccaccgagggcguggugcccuucggcaaggacguggugcugaccgccagccaggacguggccgccgacggcgaguacagccugaagguggagaacagaaccagccccugggacggcguggagaucgaccugaccggcaaggugaagagcggcgccgacuaccugcugagcuuccagguguaccagagcagcgacgccccccagcuguucaacgugguggccagaaccgaggacgagaagggcgagagauacgacgugauccuggacaaggugguggugagcgaccacuggaaggagauccuggugcccuucagccccaccuucgagggcacccccgccaaguacagccugaucaucguggccagcaagaacaccaacuucaacuucuaccuggacaaggugcaggugcuggcccccaaggagagcggccccaaggugaucuacgagaccagcuucgagaacggcgugggcgacuggcagcccagaggcgacgugaacaucgaggccagcagcgagguggcccacagcggcaagagcagccuguucaucagcaacagacagaagggcuggcagggcgcccagaucaaccugaagggcauccugaagaccggcaagaccuacgccuucgaggccuggguguaccagaacagcggccaggaccagaccaucaucaugaccaugcagagaaaguacagcagcgacgccagcacccaguacgaguggaucaagagcgccaccgugcccagcggccagugggugcagcugagcggcaccuacaccauccccgccggcgugaccguggaggaccugacccuguacuucgagagccagaaccccacccuggaguucuacguggacgacgugaagaucguggacaccaccagcgccgagaucaagaucgagauggagcccgagaaggagauccccgcccugaaggaggugcugaaggacuacuucaaggugggcguggcccugcccagcaagguguuccugaaccccaaggacaucgagcugaucaccaagcacuucaacagcaucaccgccgagaacgagaugaagcccgagagccugcuggccggcaucgagaacggcaagcugaaguucagauucgagaccgccgacaaguacauccaguucguggaggagaacggcauggugaucagaggccacacccugguguggcacaaccagacccccgacugguucuucaaggacgagaacggcaaccugcugagcaaggaggccaugaccgagagacugaaggaguacauccacaccguggugggccacuucaagggcaagguguacgccugggacguggugaacgaggccguggaccccaaccagcccgacggccugagaagaagcaccugguaccagaucaugggccccgacuacaucgagcuggccuucaaguucgccagagaggccgaccccgacgccaagcuguucuacaacgacuacaacaccuucgagcccagaaagagagacaucaucuacaaccuggugaaggaccugaaggagaagggccugaucgacggcaucggcaugcagugccacaucagccuggccaccgacaucaagcagaucgaggaggccaucaagaaguucagcaccauccccggcaucgagauccacaucaccgagcuggacaugagcguguacagagacagcagcagcaacuaccccgaggcccccagaaccgcccugaucgagcaggcccacaagaugaugcagcuguucgagaucuucaagaaguacagcaacgugaucaccaacgugaccuucuggggccugaaggacgacuacagcuggagagccaccagaagaaacgacuggccccugaucuucgacaaggaccaccaggccaagcuggccuacugggccaucguggcccccgaggugcugcccccccugcccaaggagagcagaaucagcgagggcgaggccgugguggugggcaugauggacgacagcuaccugaugagcaagcccaucgagauccuggacgaggagggcaacgugaaggccaccaucagagccguguggaaggacagcaccaucuacaucuacggcgaggugcaggacaagaccaagaagcccgccgaggacggcguggccaucuucaucaaccccaacaacgagagaacccccuaccugcagcccgacgacaccuacgccgugcuguggaccaacuggaagaccgaggugaacagagaggacgugcaggugaagaaguucgugggccccggcuucagaagauacagcuucgagaugagcaucaccauccccggcguggaguucaagaaggacagcuacaucggcuucgacgccgccgugaucgacgacggcaagugguacagcuggagcgacaccaccaacagccagaagaccaacaccaugaacuacggcacccugaagcuggagggcaucaugguggccaccgccaaguacggcacccccgugaucgacggcgagaucgacgagaucuggaacaccaccgaggagaucgagaccaaggccguggccaugggcagccuggacaagaacgccaccgccaaggugagagugcugugggacgagaacuaccuguacgugcuggccaucgugaaggaccccgugcugaacaaggacaacagcaaccccugggagcaggacagcguggagaucuucaucgacgagaacaaccacaagaccggcuacuacgaggacgacgacgcccaguucagagugaacuacaugaacgagcagaccuucggcaccggcggcagccccgccagauucaagaccgccgugaagcugaucgagggcggcuacaucguggaggccgccaucaaguggaagaccaucaagcccacccccaacaccgugaucggcuucaacauccaggugaacgacgccaacgagaagggccagagagugggcaucaucagcuggagcgaccccaccaacaacagcuggagagaccccagcaaguucggcaaccugagacugaucaag

SEQ ID NO: 36107 - RNA, 3177 nt, Artificial Sequence; identical to SEQ ID NO: 36106
  derived and/or modified sequence opt4 from anti-influenza_Chain

SEQ ID NO: 36108 - RNA, 318 nt, Artificial Sequence
  derived and/or modified sequence opt4 from anti-OX40_LightChain
gagaucguggugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccaccuucggccagggcaccaagguggagaucaag

SEQ ID NO: 36109 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuacccccccaccuucggcggcggcaccaagguggagaucaag

SEQ ID NO: 36110 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcagacugagaagcggcgugcccagcagauucagcggcagcggcagcggcaccgacuucacccugaccaucagcagccugcagcccgaggacuucgccaccuacuacugccagcagggccacacccugccccccaccuucggccagggcaccaagguggagaucaag

SEQ ID NO: 36111 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaagaccgugaagcugcugaucuacuacaccagcagacugagaagcggcgugcccagcagauucagcggcagcggcagcggcaccgacuucacccugaccaucagcagccugcagcccgaggacuucgccaccuacuacugccagcagggccacacccugccccccaccuucggccagggcaccaagguggagaucaag

SEQ ID NO: 36112 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaagaccgugaagcugcugaucuacuacaccagcagacugagaagcggcgugcccagcagauucagcggcagcggcagcggcaaggacuacacccugaccaucagcagccugcagcccgaggacuucgccaccuacuucugccagcagggccacacccugccccccaccuucggccagggcaccaagguggagaucaag

SEQ ID NO: 36113 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcagacugagaagcggcgugcccagcagauucagcggcagcggcagcggcaccgacuucacccugaccaucagcagccugcagcccgaggacuucgccaccuacuacugccagcagggccacacccugcccgccaccuucggccagggcaccaagguggagaucaag

SEQ ID NO: 36114 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcagacugagaagcggcgugcccagcagauucagcggcagcggcagcggcaccgacuucacccugaccaucagcagccugcagcccgaggacuucgccaccuacuacugccagcagggccacaccgccccccccaccuucggccagggcaccaagguggagaucaag

SEQ ID NO: 36115 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcagacugagaagcggcgugcccagcagauucagcggcagcggcagcggcaccgacuucacccugaccaucagcagccugcagcccgaggacuucgccaccuacuacugccagcagggcgccacccugccccccaccuucggccagggcaccaagguggagaucaag

SEQ ID NO: 36116 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcagacugagaagcggcgugcccagcagauucagcggcagcggcagcggcaccgacuucacccugaccaucagcagccugcagcccgaggacuucgccaccuacuacugccagcagggccacgcccugccccccaccuucggccagggcaccaagguggagaucaag

SEQ ID NO: 36117 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcagacugagaagcggcgugcccagcagauucagcggcagcggcagcggcaccgacuucacccugaccaucagcagccugcagcccgaggacuucgccaccuacuacugccagcaggcccacacccugccccccaccuucggccagggcaccaagguggagaucaag

SEQ ID NO: 36118 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcagacugagaagcggcgugcccagcagauucagcggcagcggcagcggcaccgacuucacccugaccaucagcagccugcagcccgaggacuucgccaccuacuacugccagcagggccacacccuggcccccaccuucggccagggcaccaagguggagaucaag

SEQ ID NO: 36119 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcagacugagaagcggcgugcccagcagauucagcggcagcggcagcggcaccgacuucacccugaccaucagcagccugcagcccgaggacuucgccaccuacuacugccaggccggccacacccugccccccaccuucggccagggcaccaagguggagaucaag

SEQ ID NO: 36120 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaaggcccccaagcugcugaucuacuacaccagcaagcugcacagcggcgugcccagcagauucagcggcagcggcagcggcaccgacuacacccugaccaucagcagccugcagcccgaggacuucgccaccuacuacugccagcagggcagcgcccugcccuggaccuucggccagggcaccaagguggagaucaag

SEQ ID NO: 36121 - RNA, 321 nt, Artificial Sequence
  derived and/or modified sequence opt4 from anti-OX40_LightChain
gacauccagaugacccagagccccagcagccugagcgccagcgugggcgacagagugaccaucaccugcagagccagccaggacaucagcaacuaccugaacugguaccagcagaagcccggcaaggccgugaagcugcugaucuacuacaccagcaagcugcacagcggcgugcccagcagauucagcggcagcggcagcagaaccgacuacacccugaccaucagcagccugcagcccgaggacuucgccaccuacuacugccagcagggcagcgcccugcccuggaccuucggccagggcaccaagguggagaucaag

SEQ ID NO: 36122 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacggcgacagcagcuacaaccagaaguucagagagagagugaccaucaccagagacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36123 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacggcgacagcagcuacaaccagaaguucagagagagagugaccaucaccguggacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36124 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacggcgacagcagcuacaaccagaaguucagagagagagugacccugaccguggacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36125 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacgccuacaugagcugggugagacaggcccccggccagggccuggaguggaucggcgacauguaccccgacaacggcgacagcagcuacaaccagaaguucagagagagagugaccaucaccagagacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36126 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgagagcuacaugagcugggugagacaggcccccggccagggccuggaguggaucggcgacauguaccccgacaacggcgacagcagcuacaaccagaaguucagagagagagugaccaucaccagagacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36127 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacgccgacagcagcuacaaccagaaguucagagagagagugaccaucaccagagacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36128 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacgccgacgccagcuacaaccagaaguucagagagagagugaccaucaccagagacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36129 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacggcgacgccagcuacaaccagaaguucagagagagagugaccaucaccagagacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36130 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacagcggcgacagcagcuacaaccagaaguucagagagagagugaccaucaccagagacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36131 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacggcagcagcagcuacaaccagaaguucagagagagagugaccaucaccagagacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36132 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacgccuacaugagcugggugagacaggcccccggccagggccuggaguggaucggcgacauguaccccgacaacgccgacgccagcuacaaccagaaguucagagagagagugaccaucaccagagacaccagcaccagcaccgccuaccuggagcugagcagccugagaagcgaggacaccgccguguacuacugcgugcuggcccccagaugguacuucagcguguggggccagggcacccuggugaccgugagcagc

SEQ ID NO: 36133 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacggcgacagcagcuacaaccagaaguucagagagagagugaccaucaccagagacaccagcaccagcaccgccuaccuggagcugagcagccugagaagcgaggacaccgccguguacuacugcgugcuggcccccagaugguacuucagcgccuggggccagggcacccuggugaccgugagcagc

SEQ ID NO: 36134 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacggcgacagcagcuacaaccagaaguucagagagagagugaccaucaccagagacaccagcaccagcaccgccuaccuggagcugagcagccugagaagcgaggacaccgccguguacuacugcgugcuggcccccagaugguacuucgccguguggggccagggcacccuggugaccgugagcagc

SEQ ID NO: 36135 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacggcgacagcagcuacaaccagaaguucagagagagagugaccaucaccagagacaccagcaccagcaccgccuaccuggagcugagcagccugagaagcgaggacaccgccguguacuacugcgcccuggcccccagaugguacuucagcguguggggccagggcacccuggugaccgugagcagc

SEQ ID NO: 36136 - RNA, 351 nt, Artificial Sequence
  derived and/or modified sequence opt4 from anti-OX40_HeavyChain
gaggugcagcuggugcagagcggcgccgaggugaagaagcccggcgccagcgugaaggugagcugcaaggccagcggcuacaccuucaccgacagcuacaugagcugggugagacaggcccccggccagggccuggaguggaucggcgacauguaccccgacaacggcgacagcagcuacaaccagaaguucagagagagagugaccaucaccagagacaccagcaccagcaccgccuaccuggagcugagcagccugagaagcgaggacaccgccguguacuacugcguggccgcccccagaugguacuucagcguguggggccagggcacccuggugaccgugagcagc

SEQ ID NO: 36137 - RNA, 354 nt, Artificial Sequence
  derived and/or modified sequence opt4 from anti-OX40_HeavyChain
gaggugcagcugguggagagcggcggcggccuggugcagcccggcggcagccugagacugagcugcgccgccagcggcuucaccuucagcagcuacagcaugaacugggugagacaggcccccggcaagggccuggagugggugagcuacaucagcagcagcagcagcaccaucgacuacgccgacagcgugaagggcagauucaccaucagcagagacaacgccaagaacagccuguaccugcagaugaacagccugagagacgaggacaccgccguguacuacugcgccagagagagcggcugguaccuguucgacuacuggggccagggcacccuggugaccgugagcagc

SEQ ID NO: 36138 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagacagcaccccggcaagggccuggaguggaucggcuacaucagcuacaacggcaucaccuaccacaaccccagccugaagagcagaaucaccaucaaccccgacaccagcaagaaccaguucagccugcagcugaacagcgugacccccgaggacaccgccguguacuacugcgccagauacagauacgacuacgacggcggccacgccauggacuacuggggccagggcacccuggugaccgugagcagc

SEQ ID NO: 36139 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguggaucggcuacaucagcuacaacggcaucaccuaccacaaccccagccugaagagcagaaucaccaucaacagagacaccagcaagaaccaguucagccugcagcugaacagcgugacccccgaggacaccgccguguacuacugcgccagauacagauacgacuacgacggcggccacgccauggacuacuggggccagggcacccuggugaccgugagcagc

SEQ ID NO: 36140 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcgacagcuucagcagcggcuacuggaacuggaucagaaagcaccccggcaagggccuggaguacaugggcuacaucagcuacaacggcaucaccuaccacaaccccagccugaagagcagaaucaccaucaacagagacaccagcaagaaccaguacagccugcagcugaacagcgugacccccgaggacaccgccguguacuucugcgccagauacagauacgacuacgacggcggccacgccauggacuacuggggccagggcacccuggugaccgugagcagc

SEQ ID NO: 36141 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcgacagcuucagcagcggcuacuggaacuggaucagaaagcaccccggcaagggccuggaguacaucggcuacaucagcuacaacggcaucaccuaccacaaccccagccugaagagcagaaucaccaucaacagagacaccagcaagaaccaguacagccugcagcugaacagcgugacccccgaggacaccgccguguacuucugcgccagauacagauacgacuacgacggcggccacgccauggacuacuggggccagggcacccuggugaccgugagcagc

SEQ ID NO: 36142 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcgacagcuucagcagcggcuacuggaacuggaucagaaagcaccccggcaagggccuggaguacaucggcuacaucagcuacaacggcaucaccuaccacaaccccagccugaagagcagaaucaccaucaacagagacaccagcaagaaccaguucagccugcagcugaacagcgugacccccgaggacaccgccguguacuucugcgccagauacagauacgacuacgacggcggccacgccauggacuacuggggccagggcacccuggugaccgugagcagc

SEQ ID NO: 36143 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcgacagcuucagcagcggcuacuggaacuggaucagaaagcaccccggcaagggccuggaguacaucggcuacaucagcuacaacggcaucaccuaccacaaccccagccugaagagcagaaucaccaucaacagagacaccagcaagaaccaguacagccugcagcugaacagcgugacccccgaggacaccgccguguacuacugcgccagauacagauacgacuacgacggcggccacgccauggacuacuggggccagggcacccuggugaccgugagcagc

SEQ ID NO: 36144 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcgacagcuucagcagcggcuacuggaacuggaucagaaagcaccccggcaagggccuggaguacaucggcuacaucagcuacaacggcaucaccuaccacaaccccagccugaagagcagaaucaccaucaacagagacaccagcaagaaccaguucagccugcagcugaacagcgugacccccgaggacaccgccguguacuacugcgccagauacagauacgacuacgacggcggccacgccauggacuacuggggccagggcacccuggugaccgugagcagc

SEQ ID NO: 36145 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacaacggcaucaccuaccacaaccccagccugaagagcagaaucaccaucaaccccgacaccagcaagaaccaguacagccugcagcugaacagcgugacccccgaggacaccgccguguacuucugcgccagauacagauacgacuacgacggcggccacgccauggacuacuggggccagggcacccuggugaccgugagcagc

SEQ ID NO: 36146 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacaacggcaucaccuaccacaaccccagccugaagagcagaaucaccaucaacagagacaccagcaagaaccaguacagccugcagcugaacagcgugacccccgaggacaccgccguguacuucugcgccagauacagauacgacuacgacggcggccacgccauggacuacuggggccagggcacccuggugaccgugagcagc

SEQ ID NO: 36147 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacaacggcaucaccuaccacaaccccagccugaagagcagaaucaccaucaacagagacaccagcaagaaccaguacagccugcagcugaacagcgugacccccgaggacaccgccguguacuacugcgccagauacagauacgacuacgacggcggccacgccauggacuacuggggccagggcacccuggugaccgugagcagc

SEQ ID NO: 36148 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacaacggcaucaccuaccacaaccccagccugaagagcagaaucaccaucaaccccgacaccagcaagaaccaguacagccugcagcugaacagcgugacccccgaggacaccgccguguacuacugcgccagauacagauacgacuacgacggcggccacgccauggacuacuggggccagggcacccuggugaccgugagcagc

SEQ ID NO: 36149 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacaacgccaucaccuaccacaaccccagccugaagagcagaaucaccaucaacagagacaccagcaagaaccaguacagccugcagcugaacagcgugacccccgaggacaccgccguguacuacugcgccagauacaaguacgacuacgacgccggccacgccauggacuacuggggccagggcacccuggugaccgugagcagc

SEQ ID NO: 36150 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacaacgccaucaccuaccacaaccccagccugaagagcagaaucaccaucaacagagacaccagcaagaaccaguacagccugcagcugaacagcgugacccccgaggacaccgccguguacuacugcgccagauacagauacgacuacgacggcggccacgccauggacuacuggggccagggcacccuggugaccgugagcagc

SEQ ID NO: 36151 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacaacggcaucaccuaccacaaccccagccugaagagcagaaucaccaucaacagagacaccagcaagaaccaguacagccugcagcugaacagcgugacccccgaggacaccgccguguacuacugcgccagauacaaguacgacuacgacggcggccacgccauggacuacuggggccagggcacccuggugaccgugagcagc

SEQ ID NO: 36152 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacagcggcaucaccuaccacaaccccagccugaagagcagaaucaccaucaacagagacaccagcaagaaccaguacagccugcagcugaacagcgugacccccgaggacaccgccguguacuacugcgccagauacagauacgacuacgacggcggccacgccauggacuacuggggccagggcacccuggugaccgugagcagc

SEQ ID NO: 36153 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacagcggcaucaccuaccacaaccccagccugaagagcagaaucaccaucaacagagacaccagcaagaaccaguacagccugcagcugaacagcgugacccccgaggacaccgccguguacuacugcgccagauacaaguacgacuacgacggcggccacgccauggacuacuggggccagggcacccuggugaccgugagcagc

SEQ ID NO: 36154 - RNA, 363 nt, Artificial Sequence
  derived and/or modified sequence opt4 from anti-OX40_HeavyChain
gaggugcagcugcaggagagcggccccagccuggugaagcccagccagacccugagccugaccugcagcgugaccggcgacagcuucaccagcggcuacuggaacuggaucagaaaguuccccggcaacagacuggaguacaugggcuacaucagcuacaacgccaucaccuaccacaaccccagccugaagagcagaaucagcaucaccagagacaccagcaagaaccacuacuaccugcagcugaacagcgugaccaccgaggacaccgccaccuacuucugcgccagauacagauacgacuacgacggcggccacgccauggacuacuggggccagggcacccuggugaccgugagcagc

SEQ ID NO: 36155 - RNA, 363 nt, Artificial Sequence
  derived and/or modified sequence opt4 from anti-OX40_HeavyChain
caggugcagcugcaggagagcggccccggccuggugaagcccagccagacccugagccugaccugcgccguguacggcggcagcuucagcagcggcuacuggaacuggaucagaaagcaccccggcaagggccuggaguacaucggcuacaucagcuacaacgccaucaccuaccacaaccccagccugaagagcagaaucaccaucaacagagacaccagcaagaaccaguacagccugcagcugaacagcgugacccccgaggacaccgccguguacuacugcgccagauacaaguacgacuacgacggcggccacgccauggacuacuggggccagggcacccuggugaccgugagcagc

SEQ ID NO: 36156 - RNA, 372 nt, Artificial Sequence
  derived and/or modified sequence opt4 from anti-OX40_HeavyChain
gaggugcagcugguggagagcggcggcggccuggugcagcccggcagaagccugagacugagcugcgccgccagcggcuucaccuucgacgacuacgccaugcacugggugagacaggcccccggcaagggccuggagugggugagcggcaucagcuggaacagcggcagcaucggcuacgccgacagcgugaagggcagauucaccaucagcagagacaacgccaagaacagccuguaccugcagaugaacagccugagagccgaggacaccgcccuguacuacugcgccaaggaccagagcaccgccgacuacuacuucuacuacggcauggacguguggggccagggcaccaccgugaccgugagcagc

SEQ ID NO: 36157 - RNA, 381 nt, Artificial Sequence
  derived and/or modified sequence opt4 from anti-OX40_LightChain
auggagacccccgcccagcugcuguuccugcugcugcuguggcugcccgacaccaccggcgagaucgugcugacccagagccccggcacccugagccugagccccggcgagagagccauccugagcugcagagccagccagagcgugagcagcagcuuccuggccugguaccagcagaagcccggccaggcccccagacugcugaucuacggcgccuucagcagagccaccggcauccccgacagauucagcggcagcggcagcggcaccgacuucacccugaccaucagcagacuggagcccgaggacuucgccguguacuacugccagcaguacgacagcagcagaaccuucggccagggcaccaagguggagaucaag

SEQ ID NO: 36158 - RNA, 381 nt, Artificial Sequence
  derived and/or modified sequence opt4 from anti-OX40_LightChain
auggaggcccccgcccagcugcuguuccugcugcugcuguggcugcccgacaccaccggcgagaucgugcugacccagagccccgccacccugagccugagccccggcgagagagccacccugagcugcagagccagccagggcgugagcagcuaccuggccugguaccagcagaagcccggccaggcccccagacugcugaucuacgacgccagcaacagagccaccggcauccccgccagauucagcggcagcggccccggcaccgacuucacccugaccaucagcagccuggagcccgaggacuucgccguguacuacugccagcagagaagcaacuggcaccccaccuucggccagggcaccaagguggagaucaag

SEQ ID NO: 36159 - RNA, 381 nt, Artificial Sequence
  derived and/or modified sequence opt4 from anti-OX40_LightChain
auggaggcccccgcccagcugcuguuccugcugcugcuguggcugcccgacaccaccggcgagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccaucaccuucggccagggcaccagacuggagaucaag

SEQ ID NO: 36160 - RNA, 387 nt, Artificial Sequence
  derived and/or modified sequence opt4 from anti-OX40_LightChain
auggagacccccgcccagcugcuguuccugcugcugcuguggcugcccgacaccaccggcgagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacgacagcagccugaccuucggcggcggcaccaagguggagaucaagagaacc

SEQ ID NO: 36161 - RNA, 390 nt, Artificial Sequence
  derived and/or modified sequence opt4 from anti-OX40_LightChain
auggacaugagagugcuggcccagcugcugggccugcugcugcugugcuuccccggcgccagaugcgacauccagaugacccagagccccagcagccugagcgccagcgugggcaacagagugaccaucaccugcagagccagccaggacaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuacccccugaccuucggccagggcaccagacuggagaucaagaga

SEQ ID NO: 36162 - RNA, 408 nt, Artificial Sequence
  derived and/or modified sequence opt4 from anti-OX40_HeavyChain
auggacacccugugcagcacccugcugcugcugaccauccccagcugggugcugagccagaucacccugaaggagagcggccccacccuggugaagcccacccagacccugacccugagcugcaccuucagcggcuucagccugagcaccagcggcgugggcgugggcuggaucagacagccccccggcaaggcccuggaguggcuggcccugauccacugggacgacgccgagagauacagccccagccugaagagcagacugaccaucaccaaggacaccagcaagaaccagguggugcugaccaugaccaacauggaccugguggacaccgccaccuacuacugcgcccacaccagaggcgccuucgacaucuggggccagggcaccauggugaccgugagcagc

SEQ ID NO: 36163 - RNA, 408 nt, Artificial Sequence
  derived and/or modified sequence opt4 from anti-OX40_HeavyChain
auggacacccugugcagcacccugcugcugcugaccauccccagcugggugcugagccagaucacccugaaggagagcggccccacccuggugaagcccacccagacccugacccugaccugcaccuucagcggcuucagccugagcaccagcggcgugggcgugggcuggaucagacagccccccggcaaggcccuggaguggcuggcccugaucuacugggacgaccacagccccuacagccccagccugaagagcagacugaccaucaccaaggacaccagcaagaaccagguggugcugaccaugaccaacauggaccccguggacaccgccaccuacuacugcgccagaaccagaggcgccuucgacaucuggggccagggcaccauggugaccgugagcagc

SEQ ID NO: 36164 - RNA, 420 nt, Artificial Sequence
  derived and/or modified sequence opt4 from anti-OX40_HeavyChain
auggaguggggccccugcuggguguuccugguggugauccuggagggcgugcagugcggcgugcagcugguggagagcggcggcggccuggugcagcccggcggcagccugagacugagcugcgccgccagcggcuucaccuucagcagcuacagcaugaacugggugagacaggcccccggcaagggccuggagugggugagcuacaucagcagcagcagcagcaccaucuacuacgccgacagcgugaagggcagauucaccaucagcagagacaacgccaagaacagccuguaccugcagaugaacagccugagagacgaggacaccgccguguacuacugcgccagaggcguguaccacaacggcuggagcuucuucgacuacuggggccagggcacccugcugaccgugagcagc

SEQ ID NO: 36165 - RNA, 423 nt, Artificial Sequence
  derived and/or modified sequence opt4 from anti-OX40_HeavyChain
auggacacccugugcagcacccugcugcugcugaccauccccagcugggugcugagccagaucacccugaaggagagcggccccacccuggugaagcccaagcagacccugacccugaccugcaccuucagcggcuucagccugagcaccagcggcaugggcgugggcuggaucagacagccccccggcaaggcccuggaguggcuggccgugaucuacugggacgaccaccagcuguacagccccagccugaagagcagacugaccaucaccaaggacaccagcaagaaccagguggugcugaccaugaccaacauggaccccguggacaccgccaccuacuacugcgcccacagaagaggcgccuuccagcacuggggccagggcacccuggugaccgugagcagcgccagcaccaagggc

SEQ ID NO: 36166 - RNA, 462 nt, Artificial Sequence
  derived and/or modified sequence opt4 from anti-OX40_HeavyChain
augaccaugaucacccccagccuggugcccagcagcgacccccuggugaccgccgccagcgugcuggaguucgcccugcugaucagacugaccaucggccaggccguggugagcacccagagcaccggcggcggccuggugcagcccggcagaagccugagacugagcugcgccgccagcggcuucacccuggacgacuacggcaugcacugggugagacaggcccccggcaagggccuggagugggugagcggcaucagcuggaacagcgacagcaucggcuacguggacagcgugaagggcagauucaccaucagcagagacaacgccaagaacagccuguaccugcagaugaacagccugagaguggaggacaccgcccuguacuacugcgugaaggacaucagcggcugguacagcuucgacuacuggggccagggcacccuggugaccgugagcagc

SEQ ID NO: 36167 - RNA, 639 nt, Artificial Sequence
  derived and/or modified sequence opt4 from anti-OX40_LightChain
gagaucguggugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 36168 - RNA, 1350 nt, Artificial Sequence
  derived and/or modified sequence opt4 from anti-OX40_HeavyChain
gaggugcagcugguggagagcggcggcggccuggugcagcccggcagaagccugagacugagcugcgccgccagcggcuucaccuucgacgacuacgccaugcacugggugagacaggcccccggcaagggccuggagugggugagcggcaucagcuggaacagcggcagcaucggcuacgccgacagcgugaagggcagauucaccaucagcagagacaacgccaagaacagccuguaccugcagaugaacagccugagagccgaggacaccgcccuguacuacugcgccaaggaccagagcaccgccgacuacuacuucuacuacggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 36169 - RNA, 21 nt, Artificial Sequence
  derived and/or modified sequence opt4 from anti-HIV_VRC01_VRC02_NIH45-46_LightChain_CDR
ugccagcaguacgaguucuuc

SEQ ID NO: 36170 - RNA, 42 nt, Artificial Sequence
  derived and/or modified sequence opt4 from anti-HIV_VRC01_HeavyChain_CDR
accagaggcaagaacugcgacuacaacugggacuucgagcac

SEQ ID NO: 36171 - RNA, 21 nt, Artificial Sequence
  derived and/or modified sequence opt4 from anti-HIV_3BNC60_LightChain_CDR
ugccagguguacgaguucauc

SEQ ID NO: 36172 - RNA, 36 nt, Artificial Sequence
  derived and/or modified sequence opt4 from anti-HIV_3BNC60_HeavyChain_CDR
gccagacagagaagcgacuucugggacuucgacgug

SEQ ID NO: 36173 - RNA, 36 nt, Artificial Sequence
  derived and/or modified sequence opt4 from anti-HIV_5H/I1-BMV-D5_HeavyChain_CDR
gccagagacaaccccacccugcugggcagcgacuac

SEQ ID NO: 36174 - RNA, 33 nt, Artificial Sequence; identical to SEQ ID NO: 13248
  derived and/or modified sequence opt4 from anti-HIV_8ANC195_LightChain_CDR

SEQ ID NO: 36175 - RNA, 33 nt, Artificial Sequence
  derived and/or modified sequence opt4 from anti-HIV_CH01_CH02_CH03_LightChain_CDR
ugccagcaguacggcggcagccccuacaccuuc

SEQ ID NO: 36176 - RNA, 78 nt, Artificial Sequence
  derived and/or modified sequence opt4 from anti-HIV_CH01_HeavyChain_CDR
gccagaggcaccgacuacaccaucgacgacgccggcauccacuaccagggcagcggcaccuucugguacuucgaccug

SEQ ID NO: 36177 - RNA, 78 nt, Artificial Sequence
  derived and/or modified sequence opt4 from anti-HIV_CH02_HeavyChain_CDR
gccagaggcaccgacuacaccaucgacgaccagggcagauucuaccagggcagcggcaccuucugguacuucgacuuc

SEQ ID NO: 36178 - RNA, 78 nt, Artificial Sequence
  derived and/or modified sequence opt4 from anti-HIV_CH03_HeavyChain_CDR
gccagaggcaccgacuacaccaucgacgaccagggcaucuucuacaagggcagcggcaccuucugguacuucgaccug

SEQ ID NO: 36179 - RNA, 33 nt, Artificial Sequence
  derived and/or modified sequence opt4 from anti-HIV_CH04_LightChain_CDR
ugccagcaguacggcagaagccccuacaccuuc

SEQ ID NO: 36180 - RNA, 78 nt, Artificial Sequence
  derived and/or modified sequence opt4 from anti-HIV_CH04_HeavyChain_CDR
gccagaggcaccgacuacaccaucgacgaccagggcaucagauaccagggcagcggcaccuucugguacuucgacgug

SEQ ID NO: 36181 - RNA, 54 nt, Artificial Sequence
  derived and/or modified sequence opt4 from anti-HIV_NIH45-46_HeavyChain_CDR
accagaggcaaguacugcaccgccagagacuacuacaacugggacuucgagcac

SEQ ID NO: 36182 - RNA, 90 nt, Artificial Sequence
  derived and/or modified sequence opt4 from anti-HIV_PG16_HeavyChain_CDR
gccagagaggccggcggccccaucuggcacgacgacgugaaguacuacgacuucaacgacggcuacuacaacuaccacuacauggacgug

SEQ ID NO: 36183 - RNA, 36 nt, Artificial Sequence
  derived and/or modified sequence opt4 from anti-HIV_PGT122_LightChain_CDR
cacaucugggacagcagaagacccaccaacugggug

SEQ ID NO: 36184 - RNA, 72 nt, Artificial Sequence
  derived and/or modified sequence opt4 from anti-HIV_PGT122_HeavyChain_CDR
accaagcacggcagaagaaucuacggcgugguggccuucaaggagugguucaccuacuucuacauggacgug

SEQ ID NO: 36185 - RNA, 36 nt, Artificial Sequence
  derived and/or modified sequence opt4 from anti-HIV_PGT123_LightChain_CDR
cacaucuacgacgccagaggcggcaccaacugggug

SEQ ID NO: 36186 - RNA, 72 nt, Artificial Sequence
  derived and/or modified sequence opt4 from anti-HIV_PGT123_HeavyChain_CDR
gcccugcacggcaagagaaucuacggcaucguggcccugggcgagcuguucaccuacuucuacauggacgug

SEQ ID NO: 36187 - RNA, 30 nt, Artificial Sequence
  derived and/or modified sequence opt4 from anti-HIV_PGT125_PGT128_LightChain_CDR
ggcagccuggugggcaacugggacgugauc

SEQ ID NO: 36188 - RNA, 57 nt, Artificial Sequence
  derived and/or modified sequence opt4 from anti-HIV_PGT125_HeavyChain_CDR
uucgacggcgaggugcugguguacaaccacuggcccaagcccgccuggguggaccug

SEQ ID NO: 36189 - RNA, 30 nt, Artificial Sequence
  derived and/or modified sequence opt4 from anti-HIV_PGT126_PGT127_LightChain_CDR
agcagccuggugggcaacugggacgugauc

SEQ ID NO: 36190 - RNA, 57 nt, Artificial Sequence
  derived and/or modified sequence opt4 from anti-HIV_PGT126_HeavyChain_CDR
uucgacggcgaggugcugguguaccacgacuggcccaagcccgccuggguggaccug

SEQ ID NO: 36191 - RNA, 57 nt, Artificial Sequence
  derived and/or modified sequence opt4 from anti-HIV_PGT127_HeavyChain_CDR
uucggcggcgaggugcugguguacagagacuggcccaagcccgccuggguggaccug

SEQ ID NO: 36192 - RNA, 57 nt, Artificial Sequence
  derived and/or modified sequence opt4 from anti-HIV_PGT128_HeavyChain_CDR
uucggcggcgaggugcugagauacaccgacuggcccaagcccgccuggguggaccug

SEQ ID NO: 36193 - RNA, 30 nt, Artificial Sequence
  derived and/or modified sequence opt4 from anti-HIV_PGT130_LightChain_CDR
agcagccuguucggcagaugggacguggug

SEQ ID NO: 36194 - RNA, 57 nt, Artificial Sequence
  derived and/or modified sequence opt4 from anti-HIV_PGT130_HeavyChain_CDR
agcggcggcgacauccuguacuacuacgaguggcagaagccccacugguucagcccc

SEQ ID NO: 36195 - RNA, 30 nt, Artificial Sequence
  derived and/or modified sequence opt4 from anti-HIV_PGT131_LightChain_CDR
agcagccugagcggcagaugggacaucgug

SEQ ID NO: 36196 - RNA, 57 nt, Artificial Sequence
  derived and/or modified sequence opt4 from anti-HIV_PGT131_HeavyChain_CDR
agcggcggcgacauccuguacuacaucgaguggcagaagccccacugguucuacccc

SEQ ID NO: 36197 - RNA, 27 nt, Artificial Sequence
  derived and/or modified sequence opt4 from anti-HIV_PGT135_PGT136_PGT137_LightChain_CDR
cagcaguacgaggaguggcccagaacc

SEQ ID NO: 36198 - RNA, 54 nt, Artificial Sequence
  derived and/or modified sequence opt4 from anti-HIV_PGT135_HeavyChain_CDR
cacagacaccacgacguguucaugcuggugcccaucgccggcugguucgacgug

SEQ ID NO: 36199 - RNA, 54 nt, Artificial Sequence
  derived and/or modified sequence opt4 from anti-HIV_PGT136_HeavyChain_CDR
cacaaguaccacgacaucuucagaguggugcccguggccggcugguucgacccc

SEQ ID NO: 36200 - RNA, 54 nt, Artificial Sequence
  derived and/or modified sequence opt4 from anti-HIV_PGT137_HeavyChain_CDR
cacaaguaccacgacaucgugaugguggugcccaucgccggcugguucgacccc

SEQ ID NO: 36201 - RNA, 27 nt, Artificial Sequence
  derived and/or modified sequence opt4 from anti-HIV_PGT141_PGT142_PGT143_PGT144_LightChain_CDR
augcagggccugaacagacccuggacc

SEQ ID NO: 36202 - RNA, 96 nt, Artificial Sequence
  derived and/or modified sequence opt4 from anti-HIV_PGT141_HeavyChain_CDR
ggcagcaagcacagacugagagacuacgugcuguacgacgacuacggccugaucaacuaccaggaguggaacgacuaccuggaguuccuggacgug

SEQ ID NO: 36203 - RNA, 96 nt, Artificial Sequence
  derived and/or modified sequence opt4 from anti-HIV_PGT144_HeavyChain_CDR
ggcagcaagcacagacugagagacuacgugcuguacgacgacuacggccugaucaaccagcaggaguggaacgacuaccuggaguuccuggacgug

SEQ ID NO: 36204 - RNA, 27 nt, Artificial Sequence
  derived and/or modified sequence opt4 from anti-HIV_PGT145_LightChain_CDR
augcagggccugcacagccccuggacc

SEQ ID NO: 36205 - RNA, 93 nt, Artificial Sequence
  derived and/or modified sequence opt4 from anti-HIV_PGT145_HeavyChain_CDR
ggcagcaagcacagacugagagacuacuuccuguacaacgaguacggccccaacuacgaggaguggggcgacuaccuggccacccuggacgug

SEQ ID NO: 36206 - RNA, 21 nt, Artificial Sequence
  derived and/or modified sequence opt4 from anti-HIV_VRC-CH30_VRC-CH31_VRC-CH32_VRC-CH33_VRC-CH34_LightChain _CDR
ugccagcaguacgagaccuuc

SEQ ID NO: 36207 - RNA, 45 nt, Artificial Sequence
  derived and/or modified sequence opt4 from anti-HIV_VRC-CH30_VRC-CH31_VRC-CH32_VRC-CH34_HeavyChain_CDR
gccagagcccagaagagaggcagaagcgagugggccuacgcccac

SEQ ID NO: 36208 - RNA, 45 nt, Artificial Sequence
  derived and/or modified sequence opt4 from anti-HIV_VRC-CH33_HeavyChain_CDR
gccagagcccagaagagagccagaagcgagugggccuacgcccac

SEQ ID NO: 36209 - RNA, 21 nt, Artificial Sequence
  derived and/or modified sequence opt4 from anti-HIV_VRC-PG04_LightChain_CDR
ugccagcagcuggaguucuuc

SEQ ID NO: 36210 - RNA, 48 nt, Artificial Sequence
  derived and/or modified sequence opt4 from anti-HIV_VRC-PG04_HeavyChain_CDR
gccagacagaaguucuacaccggcggccagggcugguacuucgaccug

SEQ ID NO: 36211 - RNA, 21 nt, Artificial Sequence
  derived and/or modified sequence opt4 from anti-HIV_VRC-PG04b_LightChain_CDR
ugccagcagguggaguucuuc

SEQ ID NO: 36212 - RNA, 48 nt, Artificial Sequence
  derived and/or modified sequence opt4 from anti-HIV_VRC-PG04b_HeavyChain_CDR
gccagacagaaguucgagagaggcggccagggcugguacuucgaccug

SEQ ID NO: 36213 - RNA, 21 nt, Artificial Sequence
  derived and/or modified sequence opt4 from anti-HIV_VRC03_LightChain_CDR
ugccagcaguucgaguucuuc

SEQ ID NO: 36214 - RNA, 48 nt, Artificial Sequence
  derived and/or modified sequence opt4 from anti-HIV_VRC03_HeavyChain_CDR
gugagaagaggcagcugcgacuacugcggcgacuuccccuggcaguac

SEQ ID NO: 36215 - RNA, 21 nt, Artificial Sequence
  derived and/or modified sequence opt4 from anti-HIV_1TJG_P-Chain
gagcuggacaagugggccagc

SEQ ID NO: 36216 - RNA, 69 nt, Artificial Sequence
  derived and/or modified sequence opt4 from anti-HIV_2B1H_P-Chain
aacaacaccaagaagagcaucaagaucagacccagacaggccuucuacgccaccaacggcaucaucggc

SEQ ID NO: 36217 - RNA, 69 nt, Artificial Sequence
  derived and/or modified sequence opt4 from anti-HIV_2B1A_P-Chain
aacaacaccagaaagagcauccaccugggccccggcagagccuucuacgccaccggcgacaucaucggc

SEQ ID NO: 36218 - RNA, 57 nt, Artificial Sequence
  derived and/or modified sequence opt4 from anti-HIV_2B0S_P-Chain
aagagaaagagaauccacaucggccccggcagagccuucuacaccaccaagaacgcc

SEQ ID NO: 36219 - RNA, 69 nt, Artificial Sequence
  derived and/or modified sequence opt4 from anti-HIV_3UJJ_P-Chain
aacaacaccagaaagagcaucagaaucggccccggccaggccuucuacgccaccggcgacaucaucggc

SEQ ID NO: 36220 - RNA, 69 nt, Artificial Sequence
  derived and/or modified sequence opt4 from anti-HIV_3UJI_P-Chain
uacaacaagagaaagagaauccacaucggccccggcagagccuucuacaccaccaagaacaucaucggc

SEQ ID NO: 36221 - RNA, 75 nt, Artificial Sequence
  derived and/or modified sequence opt4 from anti-HIV_3MLZ_P-Chain
agcaacaacaccagaaagggcauccacaucggccccggcagagccuucuacgccaccggccagaucaccggcgac

SEQ ID NO: 36222 - RNA, 60 nt, Artificial Sequence
  derived and/or modified sequence opt4 from anti-HIV_3MLV_Q-Chain
aacaacaccagaaagagaaucagagugggccccggccagaccguguacgccaccaacgcc

SEQ ID NO: 36223 - RNA, 69 nt, Artificial Sequence
  derived and/or modified sequence opt4 from anti-HIV_3MLU_P-Chain
aacaacaccagaaagagcaucagaaucggccccggccaggccuucuacgccaccggcggcaucaucggc

SEQ ID NO: 36224 - RNA, 60 nt, Artificial Sequence
  derived and/or modified sequence opt4 from anti-HIV_3MLR_P-Chain
aacaacaccaagaagggcaucgccaucggccccggcagaacccuguacgccagagagaag

SEQ ID NO: 36225 - RNA, 48 nt, Artificial Sequence; identical to SEQ ID NO: 13299
  derived and/or modified sequence opt4 from anti-HIV_4XCF_P-Chain

SEQ ID NO: 36226 - RNA, 45 nt, Artificial Sequence; identical to SEQ ID NO: 13300
  derived and/or modified sequence opt4 from anti-HIV_4XBE_P-Chain

SEQ ID NO: 36227 - RNA, 48 nt, Artificial Sequence; identical to SEQ ID NO: 13301
  derived and/or modified sequence opt4 from anti-HIV_4XAW_P-Chain

SEQ ID NO: 36228 - RNA, 45 nt, Artificial Sequence
  derived and/or modified sequence opt4 from anti-HIV_2QSC_P-Chain
agaaagagaauccacaucggccccggcagagccuucuacaccacc

SEQ ID NO: 36229 - RNA, 60 nt, Artificial Sequence
  derived and/or modified sequence opt4 from anti-HIV_3MLS_S-Chain
gccugccaggccuucuacgccagcagccccagaaagagcauccacaucggcgccugcgcc

SEQ ID NO: 36230 - RNA, 42 nt, Artificial Sequence
  derived and/or modified sequence opt4 from anti-HIV_3GO1_P-Chain
agaaagagaauccacaucggccccggcagagccuucuacacc

SEQ ID NO: 36231 - RNA, 42 nt, Artificial Sequence
  derived and/or modified sequence opt4 from anti-HIV_4M1D_Q-Chain
ugcagaauccacaucggccccggcagagccuucuacaccugc

SEQ ID NO: 36232 - RNA, 39 nt, Artificial Sequence
  derived and/or modified sequence opt4 from anti-HIV_3C2A_Q-Chain
aagagcauccaccugggccccggcagagccuucuacgcc

SEQ ID NO: 36233 - RNA, 12 nt, Artificial Sequence
  derived and/or modified sequence opt4 from anti-HIV_CDR
cagagcaagacc

SEQ ID NO: 36234 - RNA, 12 nt, Artificial Sequence
  derived and/or modified sequence opt4 from anti-HIV_CDR
gaccugaucgac

SEQ ID NO: 36235 - RNA, 15 nt, Artificial Sequence
  derived and/or modified sequence opt4 from anti-HIV_CDR
gaccacuacuggagc

SEQ ID NO: 36236 - RNA, 15 nt, Artificial Sequence
  derived and/or modified sequence opt4 from anti-HIV_CDR
ggcagauucuggagc

SEQ ID NO: 36237 - RNA, 15 nt, Artificial Sequence
  derived and/or modified sequence opt4 from anti-HIV_CDR
aacuacuacuggacc

SEQ ID NO: 36238 - RNA, 15 nt, Artificial Sequence
  derived and/or modified sequence opt4 from anti-HIV_CDR
gacgccuacuggagc

SEQ ID NO: 36239 - RNA, 15 nt, Artificial Sequence
  derived and/or modified sequence opt4 from anti-HIV_CDR
gacagcuacuggagc

SEQ ID NO: 36240 - RNA, 15 nt, Artificial Sequence
  derived and/or modified sequence opt4 from anti-HIV_CDR
gacaacuacuggagc

SEQ ID NO: 36241 - RNA, 15 nt, Artificial Sequence
  derived and/or modified sequence opt4 from anti-HIV_CDR
aacagcuacuggacc

SEQ ID NO: 36242 - RNA, 15 nt, Artificial Sequence
  derived and/or modified sequence opt4 from anti-HIV_CDR
agcuacuacuggagc

SEQ ID NO: 36243 - RNA, 15 nt, Artificial Sequence
  derived and/or modified sequence opt4 from anti-HIV_CDR
agcuucggcaugcac

SEQ ID NO: 36244 - RNA, 15 nt, Artificial Sequence
  derived and/or modified sequence opt4 from anti-HIV_CDR
gccgccuuccagugg

SEQ ID NO: 36245 - RNA, 15 nt, Artificial Sequence
  derived and/or modified sequence opt4 from anti-HIV_CDR
cagcagcugagaacc

SEQ ID NO: 36246 - RNA, 15 nt, Artificial Sequence
  derived and/or modified sequence opt4 from anti-HIV_CDR
cagcaguacgacagc

SEQ ID NO: 36247 - RNA, 15 nt, Artificial Sequence
  derived and/or modified sequence opt4 from anti-HIV_CDR
cagcagcuggccacc

SEQ ID NO: 36248 - RNA, 15 nt, Artificial Sequence
  derived and/or modified sequence opt4 from anti-HIV_CDR
gagagcuuccagugg

SEQ ID NO: 36249 - RNA, 15 nt, Artificial Sequence
  derived and/or modified sequence opt4 from anti-HIV_CDR
gagguguacgaguuc

SEQ ID NO: 36250 - RNA, 15 nt, Artificial Sequence
  derived and/or modified sequence opt4 from anti-HIV_CDR
gccagccuggaguuc

SEQ ID NO: 36251 - RNA, 15 nt, Artificial Sequence
  derived and/or modified sequence opt4 from anti-HIV_CDR
agcguguacgaguuc

SEQ ID NO: 36252 - RNA, 15 nt, Artificial Sequence
  derived and/or modified sequence opt4 from anti-HIV_CDR
gccgcccuggaguuc

SEQ ID NO: 36253 - RNA, 15 nt, Artificial Sequence
  derived and/or modified sequence opt4 from anti-HIV_CDR
gccgugguggaguuc

SEQ ID NO: 36254 - RNA, 15 nt, Artificial Sequence
  derived and/or modified sequence opt4 from anti-HIV_CDR
cagcuguucgaguuc

SEQ ID NO: 36255 - RNA, 15 nt, Artificial Sequence
  derived and/or modified sequence opt4 from anti-HIV_CDR
gccguguuccagugg

SEQ ID NO: 36256 - RNA, 15 nt, Artificial Sequence
  derived and/or modified sequence opt4 from anti-HIV_CDR
gccgugcuggaguuc

SEQ ID NO: 36257 - RNA, 15 nt, Artificial Sequence
  derived and/or modified sequence opt4 from anti-HIV_CDR
aacggcuucgacgug

SEQ ID NO: 36258 - RNA, 15 nt, Artificial Sequence
  derived and/or modified sequence opt4 from anti-HIV_CDR
cagcaguacgaguuc

SEQ ID NO: 36259 - RNA, 15 nt, Artificial Sequence
  derived and/or modified sequence opt4 from anti-HIV_CDR
cagcacuacgaguuc

SEQ ID NO: 36260 - RNA, 15 nt, Artificial Sequence
  derived and/or modified sequence opt4 from anti-HIV_CDR
cagguguacgaggug

SEQ ID NO: 36261 - RNA, 15 nt, Artificial Sequence
  derived and/or modified sequence opt4 from anti-HIV_CDR
cagguguacgaguuc

SEQ ID NO: 36262 - RNA, 15 nt, Artificial Sequence
  derived and/or modified sequence opt4 from anti-HIV_CDR
uucagcaaggagagc

SEQ ID NO: 36263 - RNA, 15 nt, Artificial Sequence
  derived and/or modified sequence opt4 from anti-HIV_CDR
cugaagcugagcagc

SEQ ID NO: 36264 - RNA, 15 nt, Artificial Sequence
  derived and/or modified sequence opt4 from anti-HIV_CDR
uacaaggugagcagc

SEQ ID NO: 36265 - RNA, 15 nt, Artificial Sequence
  derived and/or modified sequence opt4 from anti-HIV_CDR
cccccccaggagagc

SEQ ID NO: 36266 - RNA, 15 nt, Artificial Sequence
  derived and/or modified sequence opt4 from anti-HIV_CDR
accgccagagacuac

SEQ ID NO: 36267 - RNA, 15 nt, Artificial Sequence
  derived and/or modified sequence opt4 from anti-HIV_CDR
augcagagcauccag

SEQ ID NO: 36268 - RNA, 15 nt, Artificial Sequence
  derived and/or modified sequence opt4 from anti-HIV_CDR
caccagcuggacacc

SEQ ID NO: 36269 - RNA, 15 nt, Artificial Sequence
  derived and/or modified sequence opt4 from anti-HIV_CDR
caccagcuggacagc

SEQ ID NO: 36270 - RNA, 15 nt, Artificial Sequence
  derived and/or modified sequence opt4 from anti-HIV_CDR
cagcagcugggcacc

SEQ ID NO: 36271 - RNA, 15 nt, Artificial Sequence
  derived and/or modified sequence opt4 from anti-HIV_CDR
cagaaggccaccacc

SEQ ID NO: 36272 - RNA, 15 nt, Artificial Sequence
  derived and/or modified sequence opt4 from anti-HIV_CDR
cuguucgccggcacc

SEQ ID NO: 36273 - RNA, 18 nt, Artificial Sequence
  derived and/or modified sequence opt4 from anti-HIV_CDR
gugagaggcagcagcccc

SEQ ID NO: 36274 - RNA, 18 nt, Artificial Sequence
  derived and/or modified sequence opt4 from anti-HIV_CDR
ggccugcuguucguggug

SEQ ID NO: 36275 - RNA, 18 nt, Artificial Sequence
  derived and/or modified sequence opt4 from anti-HIV_CDR
auggacuggaccuggagc

SEQ ID NO: 36276 - RNA, 18 nt, Artificial Sequence
  derived and/or modified sequence opt4 from anti-HIV_CDR
auggacuggaccuggaga

SEQ ID NO: 36277 - RNA, 18 nt, Artificial Sequence
  derived and/or modified sequence opt4 from anti-HIV_CDR
augaagcaccugugguuc

SEQ ID NO: 36278 - RNA, 18 nt, Artificial Sequence
  derived and/or modified sequence opt4 from anti-HIV_CDR
auggacuggaucuggaga

SEQ ID NO: 36279 - RNA, 18 nt, Artificial Sequence
  derived and/or modified sequence opt4 from anti-HIV_CDR
auggacuggaccuggacc

SEQ ID NO: 36280 - RNA, 18 nt, Artificial Sequence
  derived and/or modified sequence opt4 from anti-HIV_CDR
augaagcaccuguuccug

SEQ ID NO: 36281 - RNA, 18 nt, Artificial Sequence
  derived and/or modified sequence opt4 from anti-HIV_CDR
cagcugcugcagagcaac

SEQ ID NO: 36282 - RNA, 18 nt, Artificial Sequence
  derived and/or modified sequence opt4 from anti-HIV_CDR
ggcggcagccccgagcac

SEQ ID NO: 36283 - RNA, 18 nt, Artificial Sequence
  derived and/or modified sequence opt4 from anti-HIV_CDR
cuggagggcaccgacuac

SEQ ID NO: 36284 - RNA, 18 nt, Artificial Sequence
  derived and/or modified sequence opt4 from anti-HIV_CDR
cagcaguaccccagcacc

SEQ ID NO: 36285 - RNA, 21 nt, Artificial Sequence
  derived and/or modified sequence opt4 from anti-HIV_CDR
aacaaccacgacagacccagc

SEQ ID NO: 36286 - RNA, 21 nt, Artificial Sequence
  derived and/or modified sequence opt4 from anti-HIV_CDR
aacaaccaggacagacccgcc

SEQ ID NO: 36287 - RNA, 21 nt, Artificial Sequence
  derived and/or modified sequence opt4 from anti-HIV_CDR
aacaacaacgacagacccagc

SEQ ID NO: 36288 - RNA, 21 nt, Artificial Sequence
  derived and/or modified sequence opt4 from anti-HIV_CDR
aacaaccaggacagacccagc

SEQ ID NO: 36289 - RNA, 21 nt, Artificial Sequence
  derived and/or modified sequence opt4 from anti-HIV_CDR
gacgacagcgacagacccagc

SEQ ID NO: 36290 - RNA, 21 nt, Artificial Sequence
  derived and/or modified sequence opt4 from anti-HIV_CDR
ugggccagcaccagacacacc

SEQ ID NO: 36291 - RNA, 21 nt, Artificial Sequence
  derived and/or modified sequence opt4 from anti-HIV_CDR
ggcgccaccgccagagacuuc

SEQ ID NO: 36292 - RNA, 21 nt, Artificial Sequence
  derived and/or modified sequence opt4 from anti-HIV_CDR
gccagcaucaagcuggcccug

SEQ ID NO: 36293 - RNA, 21 nt, Artificial Sequence
  derived and/or modified sequence opt4 from anti-HIV_CDR
cagcaguacggcagaagcccc

SEQ ID NO: 36294 - RNA, 21 nt, Artificial Sequence
  derived and/or modified sequence opt4 from anti-HIV_CDR
cagcaguacuacaucagcccc

SEQ ID NO: 36295 - RNA, 21 nt, Artificial Sequence
  derived and/or modified sequence opt4 from anti-HIV_CDR
cagcagagccacagccccagc

SEQ ID NO: 36296 - RNA, 21 nt, Artificial Sequence
  derived and/or modified sequence opt4 from anti-HIV_CDR
ggcagaugcgccagaagaugg

SEQ ID NO: 36297 - RNA, 21 nt, Artificial Sequence
  derived and/or modified sequence opt4 from anti-HIV_CDR
agauuccuguucgugguggcc

SEQ ID NO: 36298 - RNA, 21 nt, Artificial Sequence
  derived and/or modified sequence opt4 from anti-HIV_CDR
augagcgugagcuuccugauc

SEQ ID NO: 36299 - RNA, 21 nt, Artificial Sequence
  derived and/or modified sequence opt4 from anti-HIV_CDR
ggcagcagcaacagaugcccc

SEQ ID NO: 36300 - RNA, 21 nt, Artificial Sequence
  derived and/or modified sequence opt4 from anti-HIV_CDR
augaagcaccugugguucuuc

SEQ ID NO: 36301 - RNA, 21 nt, Artificial Sequence
  derived and/or modified sequence opt4 from anti-HIV_CDR
gccagcugggacuucgacuuc

SEQ ID NO: 36302 - RNA, 21 nt, Artificial Sequence
  derived and/or modified sequence opt4 from anti-HIV_CDR
gagaucggcguggccgagcac

SEQ ID NO: 36303 - RNA, 21 nt, Artificial Sequence
  derived and/or modified sequence opt4 from anti-HIV_CDR
cagaaguacgacaccgccccc

SEQ ID NO: 36304 - RNA, 21 nt, Artificial Sequence
  derived and/or modified sequence opt4 from anti-HIV_CDR
cagcagagcagcagcaccccc

SEQ ID NO: 36305 - RNA, 21 nt, Artificial Sequence
  derived and/or modified sequence opt4 from anti-HIV_CDR
cagcagagcgccggcaccccc

SEQ ID NO: 36306 - RNA, 21 nt, Artificial Sequence
  derived and/or modified sequence opt4 from anti-HIV_CDR
cagcagagcagcagcaagccc

SEQ ID NO: 36307 - RNA, 21 nt, Artificial Sequence
  derived and/or modified sequence opt4 from anti-HIV_CDR
caggaguacaacaccuacacc

SEQ ID NO: 36308 - RNA, 21 nt, Artificial Sequence
  derived and/or modified sequence opt4 from anti-HIV_CDR
caggaguacaacaacuacaac

SEQ ID NO: 36309 - RNA, 21 nt, Artificial Sequence
  derived and/or modified sequence opt4 from anti-HIV_CDR
cacuacgacgcccuggacuac

SEQ ID NO: 36310 - RNA, 24 nt, Artificial Sequence
  derived and/or modified sequence opt4 from anti-HIV_CDR
gccaucuucaagggcgugcagugc

SEQ ID NO: 36311 - RNA, 24 nt, Artificial Sequence
  derived and/or modified sequence opt4 from anti-HIV_CDR
ggcccccugggcgacuacgacuuc

SEQ ID NO: 36312 - RNA, 24 nt, Artificial Sequence
  derived and/or modified sequence opt4 from anti-HIV_CDR
cagcaguacggcagcagccugaga

SEQ ID NO: 36313 - RNA, 24 nt, Artificial Sequence
  derived and/or modified sequence opt4 from anti-HIV_CDR
cagcaguacagccacuacagaacc

SEQ ID NO: 36314 - RNA, 24 nt, Artificial Sequence
  derived and/or modified sequence opt4 from anti-HIV_CDR
caguacuacggcaugagcgugacc

SEQ ID NO: 36315 - RNA, 24 nt, Artificial Sequence
  derived and/or modified sequence opt4 from anti-HIV_CDR
cagcaguacgagaacuggcugacc

SEQ ID NO: 36316 - RNA, 24 nt, Artificial Sequence
  derived and/or modified sequence opt4 from anti-HIV_CDR
agcggcgugcacuacauggacgug

SEQ ID NO: 36317 - RNA, 24 nt, Artificial Sequence
  derived and/or modified sequence opt4 from anti-HIV_CDR
cagcaguacagcggcccccugacc

SEQ ID NO: 36318 - RNA, 24 nt, Artificial Sequence
  derived and/or modified sequence opt4 from anti-HIV_CDR
cagcaguacuacaccgugcccagc

SEQ ID NO: 36319 - RNA, 24 nt, Artificial Sequence
  derived and/or modified sequence opt4 from anti-HIV_CDR
cagcaguacggcagcagcaucacc

SEQ ID NO: 36320 - RNA, 24 nt, Artificial Sequence
  derived and/or modified sequence opt4 from anti-HIV_CDR
caccaguacaacaagugggacacc

SEQ ID NO: 36321 - RNA, 24 nt, Artificial Sequence
  derived and/or modified sequence opt4 from anti-HIV_CDR
cagcagagcuacaccaccccccug

SEQ ID NO: 36322 - RNA, 24 nt, Artificial Sequence
  derived and/or modified sequence opt4 from anti-HIV_CDR
cagagaugggagaccaucgacuac

SEQ ID NO: 36323 - RNA, 24 nt, Artificial Sequence
  derived and/or modified sequence opt4 from anti-HIV_CDR
ugcagcuacgccggcagcuacacc

SEQ ID NO: 36324 - RNA, 24 nt, Artificial Sequence
  derived and/or modified sequence opt4 from anti-HIV_CDR
cagcaguacgacaaccugcccacc

SEQ ID NO: 36325 - RNA, 24 nt, Artificial Sequence
  derived and/or modified sequence opt4 from anti-HIV_CDR
cagcagugcacccugccccugacc

SEQ ID NO: 36326 - RNA, 24 nt, Artificial Sequence
  derived and/or modified sequence opt4 from anti-HIV_CDR
cagcagagcuacagcagcgugacc

SEQ ID NO: 36327 - RNA, 24 nt, Artificial Sequence
  derived and/or modified sequence opt4 from anti-HIV_CDR
cagcagagccacaccagcgugacc

SEQ ID NO: 36328 - RNA, 24 nt, Artificial Sequence
  derived and/or modified sequence opt4 from anti-HIV_CDR
cagcagaccuacgccagcgugacc

SEQ ID NO: 36329 - RNA, 24 nt, Artificial Sequence
  derived and/or modified sequence opt4 from anti-HIV_CDR
cagcaguacaacagcgacuacacc

SEQ ID NO: 36330 - RNA, 24 nt, Artificial Sequence
  derived and/or modified sequence opt4 from anti-HIV_CDR
caccuguacgugagcagacccgug

SEQ ID NO: 36331 - RNA, 24 nt, Artificial Sequence
  derived and/or modified sequence opt4 from anti-HIV_CDR
cagcaguacggcagaagcccccug

SEQ ID NO: 36332 - RNA, 24 nt, Artificial Sequence
  derived and/or modified sequence opt4 from anti-HIV_CDR
cagcaguacggcagcagcccccug

SEQ ID NO: 36333 - RNA, 24 nt, Artificial Sequence
  derived and/or modified sequence opt4 from anti-HIV_CDR
cagcaguacaacgacuggcccgcc

SEQ ID NO: 36334 - RNA, 24 nt, Artificial Sequence
  derived and/or modified sequence opt4 from anti-HIV_CDR
caccaguacggcagcagccagaga

SEQ ID NO: 36335 - RNA, 24 nt, Artificial Sequence
  derived and/or modified sequence opt4 from anti-HIV_CDR
cagcagaccuacagcagcgugacc

SEQ ID NO: 36336 - RNA, 24 nt, Artificial Sequence
  derived and/or modified sequence opt4 from anti-HIV_CDR
cagcagaccuacagaagcgugacc

SEQ ID NO: 36337 - RNA, 24 nt, Artificial Sequence
  derived and/or modified sequence opt4 from anti-HIV_CDR
cagcaguacggcagcagcuggacc

SEQ ID NO: 36338 - RNA, 24 nt, Artificial Sequence
  derived and/or modified sequence opt4 from anti-HIV_CDR
agcagcuacgccggcaucaacaac

SEQ ID NO: 36339 - RNA, 24 nt, Artificial Sequence
  derived and/or modified sequence opt4 from anti-HIV_CDR
cagaaguacggcagcagccugacc

SEQ ID NO: 36340 - RNA, 24 nt, Artificial Sequence
  derived and/or modified sequence opt4 from anti-HIV_CDR
augcaggcccuggagacccugggc

SEQ ID NO: 36341 - RNA, 24 nt, Artificial Sequence
  derived and/or modified sequence opt4 from anti-HIV_CDR
cagcaguacgccggcagccugacc

SEQ ID NO: 36342 - RNA, 24 nt, Artificial Sequence
  derived and/or modified sequence opt4 from anti-HIV_CDR
agaaacuggggcaacuucgaccac

SEQ ID NO: 36343 - RNA, 27 nt, Artificial Sequence
  derived and/or modified sequence opt4 from anti-HIV_CDR
cagcagcacuacaccacccccuggacc

SEQ ID NO: 36344 - RNA, 27 nt, Artificial Sequence
  derived and/or modified sequence opt4 from anti-HIV_CDR
cagcagagcuucgccgugcccuacacc

SEQ ID NO: 36345 - RNA, 27 nt, Artificial Sequence
  derived and/or modified sequence opt4 from anti-HIV_CDR
cagcaguacaagagcuacagcggcacc

SEQ ID NO: 36346 - RNA, 27 nt, Artificial Sequence
  derived and/or modified sequence opt4 from anti-HIV_CDR
caccaguacgccuacagccccagaacc

SEQ ID NO: 36347 - RNA, 27 nt, Artificial Sequence
  derived and/or modified sequence opt4 from anti-HIV_CDR
cagcaguacaacagcuucccccccacc

SEQ ID NO: 36348 - RNA, 27 nt, Artificial Sequence
  derived and/or modified sequence opt4 from anti-HIV_CDR
cagcagaccuacagcaaccccagaaug

SEQ ID NO: 36349 - RNA, 27 nt, Artificial Sequence
  derived and/or modified sequence opt4 from anti-HIV_CDR
cagcaguacgaggacccccccuggacc

SEQ ID NO: 36350 - RNA, 27 nt, Artificial Sequence
  derived and/or modified sequence opt4 from anti-HIV_CDR
caccaguacuucaacacccccagaacc

SEQ ID NO: 36351 - RNA, 27 nt, Artificial Sequence
  derived and/or modified sequence opt4 from anti-HIV_CDR
caccaguacuucagcacccccagaacc

SEQ ID NO: 36352 - RNA, 27 nt, Artificial Sequence
  derived and/or modified sequence opt4 from anti-HIV_CDR
cagcacagaagcaacuggcccuggacc

SEQ ID NO: 36353 - RNA, 27 nt, Artificial Sequence
  derived and/or modified sequence opt4 from anti-HIV_CDR
agaggcagaagacagaucggcgacuac

SEQ ID NO: 36354 - RNA, 27 nt, Artificial Sequence
  derived and/or modified sequence opt4 from anti-HIV_CDR
cagcaguacggccugagccccuggacc

SEQ ID NO: 36355 - RNA, 27 nt, Artificial Sequence
  derived and/or modified sequence opt4 from anti-HIV_CDR
cagcagaccuacaccagccccaucacc

SEQ ID NO: 36356 - RNA, 27 nt, Artificial Sequence
  derived and/or modified sequence opt4 from anti-HIV_CDR
cagcaguacggcagcagcccccccacc

SEQ ID NO: 36357 - RNA, 27 nt, Artificial Sequence
  derived and/or modified sequence opt4 from anti-HIV_CDR
cagcaguacggcaccagcagcugcacc

SEQ ID NO: 36358 - RNA, 27 nt, Artificial Sequence
  derived and/or modified sequence opt4 from anti-HIV_CDR
cagcaguacgacgacgcccccaucacc

SEQ ID NO: 36359 - RNA, 27 nt, Artificial Sequence
  derived and/or modified sequence opt4 from anti-HIV_CDR
ggcccccugcugagauaccuggacagc

SEQ ID NO: 36360 - RNA, 27 nt, Artificial Sequence
  derived and/or modified sequence opt4 from anti-HIV_CDR
ugccugaagaagaccagcagcuacgug

SEQ ID NO: 36361 - RNA, 27 nt, Artificial Sequence
  derived and/or modified sequence opt4 from anti-HIV_CDR
cagcaguacaaccacuggccccagacc

SEQ ID NO: 36362 - RNA, 27 nt, Artificial Sequence
  derived and/or modified sequence opt4 from anti-HIV_CDR
cagcaguacagcaaccugcccuacacc

SEQ ID NO: 36363 - RNA, 27 nt, Artificial Sequence
  derived and/or modified sequence opt4 from anti-HIV_CDR
cagcaguacgacaccuaccccggcacc

SEQ ID NO: 36364 - RNA, 27 nt, Artificial Sequence
  derived and/or modified sequence opt4 from anti-HIV_CDR
caggaguacagcagcacccccuacaac

SEQ ID NO: 36365 - RNA, 27 nt, Artificial Sequence
  derived and/or modified sequence opt4 from anti-HIV_CDR
ggcgccugggacgacacccuguacgug

SEQ ID NO: 36366 - RNA, 27 nt, Artificial Sequence
  derived and/or modified sequence opt4 from anti-HIV_CDR
gccgccugggacgacacccuguacgug

SEQ ID NO: 36367 - RNA, 27 nt, Artificial Sequence
  derived and/or modified sequence opt4 from anti-HIV_CDR
cagcaguacuacagcgacagcaucacc

SEQ ID NO: 36368 - RNA, 27 nt, Artificial Sequence
  derived and/or modified sequence opt4 from anti-HIV_CDR
cagcaguacggcagaagccccuacacc

SEQ ID NO: 36369 - RNA, 27 nt, Artificial Sequence
  derived and/or modified sequence opt4 from anti-HIV_CDR
cagcaguacaccaacuaccccuggacc

SEQ ID NO: 36370 - RNA, 27 nt, Artificial Sequence
  derived and/or modified sequence opt4 from anti-HIV_CDR
cagcagagacacaacuggcccaucagc

SEQ ID NO: 36371 - RNA, 27 nt, Artificial Sequence
  derived and/or modified sequence opt4 from anti-HIV_CDR
cagcaguaccacaacuggcccagaacc

SEQ ID NO: 36372 - RNA, 27 nt, Artificial Sequence
  derived and/or modified sequence opt4 from anti-HIV_CDR
cagcagagaagcaccuggccccccacc

SEQ ID NO: 36373 - RNA, 27 nt, Artificial Sequence
  derived and/or modified sequence opt4 from anti-HIV_CDR
cagcaguacgacagcuucagcuggacc

SEQ ID NO: 36374 - RNA, 27 nt, Artificial Sequence
  derived and/or modified sequence opt4 from anti-HIV_CDR
cagcaguacaacaaccugcccgugacc

SEQ ID NO: 36375 - RNA, 27 nt, Artificial Sequence
  derived and/or modified sequence opt4 from anti-HIV_CDR
cagcaguacaacagauacagcuacacc

SEQ ID NO: 36376 - RNA, 27 nt, Artificial Sequence
  derived and/or modified sequence opt4 from anti-HIV_CDR
caggaguacuacauccugcccugcagc

SEQ ID NO: 36377 - RNA, 27 nt, Artificial Sequence
  derived and/or modified sequence opt4 from anti-HIV_CDR
cagcaguacgacaaccugcuggcccac

SEQ ID NO: 36378 - RNA, 27 nt, Artificial Sequence
  derived and/or modified sequence opt4 from anti-HIV_CDR
caccagugcgacaaccugaucgccaga

SEQ ID NO: 36379 - RNA, 27 nt, Artificial Sequence
  derived and/or modified sequence opt4 from anti-HIV_CDR
cagcagagcuucagcacccuguggacc

SEQ ID NO: 36380 - RNA, 27 nt, Artificial Sequence
  derived and/or modified sequence opt4 from anti-HIV_CDR
caccagagcuacagcaccccccccacc

SEQ ID NO: 36381 - RNA, 27 nt, Artificial Sequence
  derived and/or modified sequence opt4 from anti-HIV_CDR
cagcagggcuacagcacccccuggacc

SEQ ID NO: 36382 - RNA, 27 nt, Artificial Sequence
  derived and/or modified sequence opt4 from anti-HIV_CDR
cagcaguacagcaccacccccagaacc

SEQ ID NO: 36383 - RNA, 27 nt, Artificial Sequence
  derived and/or modified sequence opt4 from anti-HIV_CDR
cagcuguacaacagcgugccccagacc

SEQ ID NO: 36384 - RNA, 27 nt, Artificial Sequence
  derived and/or modified sequence opt4 from anti-HIV_CDR
cagcagagaaccagcuggccccagacc

SEQ ID NO: 36385 - RNA, 27 nt, Artificial Sequence
  derived and/or modified sequence opt4 from anti-HIV_CDR
cagcaguucaacaccuacagccagacc

SEQ ID NO: 36386 - RNA, 27 nt, Artificial Sequence
  derived and/or modified sequence opt4 from anti-HIV_CDR
augcagagccugcagacccccaucacc

SEQ ID NO: 36387 - RNA, 27 nt, Artificial Sequence
  derived and/or modified sequence opt4 from anti-HIV_CDR
cagcaguacaacagcuacccccugacc

SEQ ID NO: 36388 - RNA, 27 nt, Artificial Sequence
  derived and/or modified sequence opt4 from anti-HIV_CDR
cagcaguacaacagcuacagcggcacc

SEQ ID NO: 36389 - RNA, 27 nt, Artificial Sequence
  derived and/or modified sequence opt4 from anti-HIV_CDR
cagagcuacgacagcagccugagcggc

SEQ ID NO: 36390 - RNA, 27 nt, Artificial Sequence
  derived and/or modified sequence opt4 from anti-HIV_CDR
agccagggcaacaccgccaucgacuac

SEQ ID NO: 36391 - RNA, 27 nt, Artificial Sequence
  derived and/or modified sequence opt4 from anti-HIV_CDR
gaggagcccagagacgccuucgaccug

SEQ ID NO: 36392 - RNA, 27 nt, Artificial Sequence
  derived and/or modified sequence opt4 from anti-HIV_CDR
cagcagagcuacaccacccccgugacc

SEQ ID NO: 36393 - RNA, 27 nt, Artificial Sequence
  derived and/or modified sequence opt4 from anti-HIV_CDR
gccggcagagagggcugguucgacccc

SEQ ID NO: 36394 - RNA, 27 nt, Artificial Sequence
  derived and/or modified sequence opt4 from anti-HIV_CDR
cagcaguacuacagcaccccccacacc

SEQ ID NO: 36395 - RNA, 27 nt, Artificial Sequence
  derived and/or modified sequence opt4 from anti-HIV_CDR
cagcagagcuacagcaucgccggcacc

SEQ ID NO: 36396 - RNA, 27 nt, Artificial Sequence
  derived and/or modified sequence opt4 from anti-HIV_CDR
cagaacuacaacaagccccccagaacc

SEQ ID NO: 36397 - RNA, 27 nt, Artificial Sequence
  derived and/or modified sequence opt4 from anti-HIV_CDR
augcagagcauccagcugccccugacc

SEQ ID NO: 36398 - RNA, 27 nt, Artificial Sequence
  derived and/or modified sequence opt4 from anti-HIV_CDR
augcaggcccugcagaccagccugacc

SEQ ID NO: 36399 - RNA, 27 nt, Artificial Sequence
  derived and/or modified sequence opt4 from anti-HIV_CDR
cagcaguacagcagcagccccagaacc

SEQ ID NO: 36400 - RNA, 27 nt, Artificial Sequence
  derived and/or modified sequence opt4 from anti-HIV_CDR
caggccugggacagcagcaccgccgug

SEQ ID NO: 36401 - RNA, 27 nt, Artificial Sequence
  derived and/or modified sequence opt4 from anti-HIV_CDR
cagcacuacaacaacuggcccuacacc

SEQ ID NO: 36402 - RNA, 27 nt, Artificial Sequence
  derived and/or modified sequence opt4 from anti-HIV_CDR
cagcaguacgacagacugcccaucacc

SEQ ID NO: 36403 - RNA, 27 nt, Artificial Sequence
  derived and/or modified sequence opt4 from anti-HIV_CDR
cagcaguacggcagcagccccaucacc

SEQ ID NO: 36404 - RNA, 27 nt, Artificial Sequence
  derived and/or modified sequence opt4 from anti-HIV_CDR
cagcaguacgacguguggccccugacc

SEQ ID NO: 36405 - RNA, 27 nt, Artificial Sequence
  derived and/or modified sequence opt4 from anti-HIV_CDR
caccaguacgccagcagccccagaacc

SEQ ID NO: 36406 - RNA, 27 nt, Artificial Sequence
  derived and/or modified sequence opt4 from anti-HIV_CDR
augcagagccugcaccugcccuacacc

SEQ ID NO: 36407 - RNA, 27 nt, Artificial Sequence
  derived and/or modified sequence opt4 from anti-HIV_CDR
cagcaguacuacagcagcccccugacc

SEQ ID NO: 36408 - RNA, 27 nt, Artificial Sequence
  derived and/or modified sequence opt4 from anti-HIV_CDR
cagcagcacgacaccuuccccuucacc

SEQ ID NO: 36409 - RNA, 27 nt, Artificial Sequence
  derived and/or modified sequence opt4 from anti-HIV_CDR
cagcagagcuacagcacccccuacacc

SEQ ID NO: 36410 - RNA, 27 nt, Artificial Sequence
  derived and/or modified sequence opt4 from anti-HIV_CDR
cagcaguacaagaccuaccccgugacc

SEQ ID NO: 36411 - RNA, 27 nt, Artificial Sequence
  derived and/or modified sequence opt4 from anti-HIV_CDR
cagcaguacuacagcacccccgugacc

SEQ ID NO: 36412 - RNA, 27 nt, Artificial Sequence
  derived and/or modified sequence opt4 from anti-HIV_CDR
cagcaguacaacuggccccccuucacc

SEQ ID NO: 36413 - RNA, 27 nt, Artificial Sequence
  derived and/or modified sequence opt4 from anti-HIV_CDR
augcagggcacccacuggcccuggacc

SEQ ID NO: 36414 - RNA, 27 nt, Artificial Sequence
  derived and/or modified sequence opt4 from anti-HIV_CDR
caccagugcggcagcagccccagaacc

SEQ ID NO: 36415 - RNA, 27 nt, Artificial Sequence
  derived and/or modified sequence opt4 from anti-HIV_CDR
cagcaguacaacagcuacuucagaacc

SEQ ID NO: 36416 - RNA, 27 nt, Artificial Sequence
  derived and/or modified sequence opt4 from anti-HIV_CDR
cagcaguaccacaacuggccccccagc

SEQ ID NO: 36417 - RNA, 27 nt, Artificial Sequence
  derived and/or modified sequence opt4 from anti-HIV_CDR
augcagggcaccuacuggcuguggacc

SEQ ID NO: 36418 - RNA, 27 nt, Artificial Sequence
  derived and/or modified sequence opt4 from anti-HIV_CDR
cagcagggcuucagcgcccccuucacc

SEQ ID NO: 36419 - RNA, 27 nt, Artificial Sequence
  derived and/or modified sequence opt4 from anti-HIV_CDR
cagcaguacaacaccuacccccugacc

SEQ ID NO: 36420 - RNA, 27 nt, Artificial Sequence
  derived and/or modified sequence opt4 from anti-HIV_CDR
augcagggcacccacuggcccagaacc

SEQ ID NO: 36421 - RNA, 27 nt, Artificial Sequence
  derived and/or modified sequence opt4 from anti-HIV_CDR
uucggcagaacccccugguucgacccc

SEQ ID NO: 36422 - RNA, 27 nt, Artificial Sequence
  derived and/or modified sequence opt4 from anti-HIV_CDR
cagcaguacuucaccagcgugaucacc

SEQ ID NO: 36423 - RNA, 27 nt, Artificial Sequence
  derived and/or modified sequence opt4 from anti-HIV_CDR
caccacuacaugagcgaccugcagacc

SEQ ID NO: 36424 - RNA, 27 nt, Artificial Sequence
  derived and/or modified sequence opt4 from anti-HIV_CDR
caccacuacagcagcagcagccacacc

SEQ ID NO: 36425 - RNA, 27 nt, Artificial Sequence
  derived and/or modified sequence opt4 from anti-HIV_CDR
caccacuacaagagcgacugccagacc

SEQ ID NO: 36426 - RNA, 27 nt, Artificial Sequence
  derived and/or modified sequence opt4 from anti-HIV_CDR
cagcacagaagcagcuggccccugacc

SEQ ID NO: 36427 - RNA, 27 nt, Artificial Sequence
  derived and/or modified sequence opt4 from anti-HIV_CDR
cugcagcaccacagcuaccccuggacc

SEQ ID NO: 36428 - RNA, 27 nt, Artificial Sequence
  derived and/or modified sequence opt4 from anti-HIV_CDR
cagcaguacggcaccagccccggcacc

SEQ ID NO: 36429 - RNA, 27 nt, Artificial Sequence
  derived and/or modified sequence opt4 from anti-HIV_CDR
cagcaguacggcagcagccccaccacc

SEQ ID NO: 36430 - RNA, 27 nt, Artificial Sequence
  derived and/or modified sequence opt4 from anti-HIV_CDR
cagcaguacggcaccagccccaccacc

SEQ ID NO: 36431 - RNA, 27 nt, Artificial Sequence
  derived and/or modified sequence opt4 from anti-HIV_CDR
augcaggccacccacuggccccccggc

SEQ ID NO: 36432 - RNA, 27 nt, Artificial Sequence
  derived and/or modified sequence opt4 from anti-HIV_CDR
cagagauacaacagagaccccuacauc

SEQ ID NO: 36433 - RNA, 27 nt, Artificial Sequence
  derived and/or modified sequence opt4 from anti-HIV_CDR
cagcaguacgacaaccugccccuggcc

SEQ ID NO: 36434 - RNA, 27 nt, Artificial Sequence
  derived and/or modified sequence opt4 from anti-HIV_CDR
agcagcuacagcgccaccggcguggcc

SEQ ID NO: 36435 - RNA, 27 nt, Artificial Sequence
  derived and/or modified sequence opt4 from anti-HIV_CDR
cagcacuacggcaacagcagauggacc

SEQ ID NO: 36436 - RNA, 27 nt, Artificial Sequence
  derived and/or modified sequence opt4 from anti-HIV_CDR
cagcaguacgagaccuaccccuggacc

SEQ ID NO: 36437 - RNA, 27 nt, Artificial Sequence
  derived and/or modified sequence opt4 from anti-HIV_CDR
cagcaguacggcagcagccccagcacc

SEQ ID NO: 36438 - RNA, 27 nt, Artificial Sequence
  derived and/or modified sequence opt4 from anti-HIV_CDR
cagcagagccagagaaccccccacacc

SEQ ID NO: 36439 - RNA, 27 nt, Artificial Sequence
  derived and/or modified sequence opt4 from anti-HIV_CDR
cagcaguacgacauccugccccugacc

SEQ ID NO: 36440 - RNA, 27 nt, Artificial Sequence
  derived and/or modified sequence opt4 from anti-HIV_CDR
cagcagagcaacagcagccccuggacc

SEQ ID NO: 36441 - RNA, 27 nt, Artificial Sequence
  derived and/or modified sequence opt4 from anti-HIV_CDR
cagcagagcuacgacacccccagaacc

SEQ ID NO: 36442 - RNA, 27 nt, Artificial Sequence
  derived and/or modified sequence opt4 from anti-HIV_CDR
cagcaguucggcagcagccccggcacc

SEQ ID NO: 36443 - RNA, 27 nt, Artificial Sequence
  derived and/or modified sequence opt4 from anti-HIV_CDR
caccaguacggcagcagcccccagacc

SEQ ID NO: 36444 - RNA, 27 nt, Artificial Sequence
  derived and/or modified sequence opt4 from anti-HIV_CDR
caccaguacggcagcagcccccagagc

SEQ ID NO: 36445 - RNA, 27 nt, Artificial Sequence
  derived and/or modified sequence opt4 from anti-HIV_CDR
cugcagcacaacagcuacccccugacc

SEQ ID NO: 36446 - RNA, 27 nt, Artificial Sequence
  derived and/or modified sequence opt4 from anti-HIV_CDR
cagcaguacaacgacuggcccaucacc

SEQ ID NO: 36447 - RNA, 27 nt, Artificial Sequence
  derived and/or modified sequence opt4 from anti-HIV_CDR
cagcagaccuucaccuuccccuacacc

SEQ ID NO: 36448 - RNA, 27 nt, Artificial Sequence
  derived and/or modified sequence opt4 from anti-HIV_CDR
cagcagagcuacaccuuccccuacauc

SEQ ID NO: 36449 - RNA, 27 nt, Artificial Sequence
  derived and/or modified sequence opt4 from anti-HIV_CDR
caguacuacggcagcagccccuacacc

SEQ ID NO: 36450 - RNA, 27 nt, Artificial Sequence
  derived and/or modified sequence opt4 from anti-HIV_CDR
cagcagagcuucggcacccccagaacc

SEQ ID NO: 36451 - RNA, 27 nt, Artificial Sequence
  derived and/or modified sequence opt4 from anti-HIV_CDR
cagcaguacaacgacuggcccagaacc

SEQ ID NO: 36452 - RNA, 27 nt, Artificial Sequence
  derived and/or modified sequence opt4 from anti-HIV_CDR
cagcaguacggcagcagccccagaacc

SEQ ID NO: 36453 - RNA, 27 nt, Artificial Sequence
  derived and/or modified sequence opt4 from anti-HIV_CDR
cugcagcacaacagauaccccuggacc

SEQ ID NO: 36454 - RNA, 27 nt, Artificial Sequence
  derived and/or modified sequence opt4 from anti-HIV_CDR
cugcagcacaacaacuaccccuggacc

SEQ ID NO: 36455 - RNA, 27 nt, Artificial Sequence
  derived and/or modified sequence opt4 from anti-HIV_CDR
cugcaguacagcaccuacccccugacc

SEQ ID NO: 36456 - RNA, 27 nt, Artificial Sequence
  derived and/or modified sequence opt4 from anti-HIV_CDR
cugcaguacaacgccuacccccugacc

SEQ ID NO: 36457 - RNA, 27 nt, Artificial Sequence
  derived and/or modified sequence opt4 from anti-HIV_CDR
cagcaguacgacagcgcccccgugacc

SEQ ID NO: 36458 - RNA, 27 nt, Artificial Sequence
  derived and/or modified sequence opt4 from anti-HIV_CDR
cagcagaccuacaccuuccccuacagc

SEQ ID NO: 36459 - RNA, 27 nt, Artificial Sequence
  derived and/or modified sequence opt4 from anti-HIV_CDR
ggcuacgacaacagcggccccgacuac

SEQ ID NO: 36460 - RNA, 27 nt, Artificial Sequence
  derived and/or modified sequence opt4 from anti-HIV_CDR
cagcaguacaacaacuggccccccgcc

SEQ ID NO: 36461 - RNA, 27 nt, Artificial Sequence
  derived and/or modified sequence opt4 from anti-HIV_CDR
caccaguacgcccugagccccuggacc

SEQ ID NO: 36462 - RNA, 27 nt, Artificial Sequence
  derived and/or modified sequence opt4 from anti-HIV_CDR
cagaaguacgacaccgaccccaugacc

SEQ ID NO: 36463 - RNA, 27 nt, Artificial Sequence
  derived and/or modified sequence opt4 from anti-HIV_CDR
cagcaguacaacuacuaccccaucacc

SEQ ID NO: 36464 - RNA, 27 nt, Artificial Sequence
  derived and/or modified sequence opt4 from anti-HIV_CDR
cagcagaccuucaccgaccccgugacc

SEQ ID NO: 36465 - RNA, 27 nt, Artificial Sequence
  derived and/or modified sequence opt4 from anti-HIV_CDR
gccgccugggacgacagccugcacgug

SEQ ID NO: 36466 - RNA, 27 nt, Artificial Sequence
  derived and/or modified sequence opt4 from anti-HIV_CDR
cagcaguacgccagcagccccuucacc

SEQ ID NO: 36467 - RNA, 27 nt, Artificial Sequence
  derived and/or modified sequence opt4 from anti-HIV_CDR
cagcagagcagcagcacccccuucacc

SEQ ID NO: 36468 - RNA, 27 nt, Artificial Sequence
  derived and/or modified sequence opt4 from anti-HIV_CDR
cagcagagaagcaacugggccaucacc

SEQ ID NO: 36469 - RNA, 27 nt, Artificial Sequence
  derived and/or modified sequence opt4 from anti-HIV_CDR
cagcaguacggcagcagccccuucacc

SEQ ID NO: 36470 - RNA, 27 nt, Artificial Sequence
  derived and/or modified sequence opt4 from anti-HIV_CDR
cagaaguacaacggcgcccccuggacc

SEQ ID NO: 36471 - RNA, 27 nt, Artificial Sequence
  derived and/or modified sequence opt4 from anti-HIV_CDR
cagaaguacaacaacgcccccuggacc

SEQ ID NO: 36472 - RNA, 27 nt, Artificial Sequence
  derived and/or modified sequence opt4 from anti-HIV_CDR
cagcagagagugaacuggccccccaac

SEQ ID NO: 36473 - RNA, 27 nt, Artificial Sequence
  derived and/or modified sequence opt4 from anti-HIV_CDR
cagcagagaggccacuggccccugacc

SEQ ID NO: 36474 - RNA, 27 nt, Artificial Sequence
  derived and/or modified sequence opt4 from anti-HIV_CDR
cagcaguacagauacagcgugaucauc

SEQ ID NO: 36475 - RNA, 27 nt, Artificial Sequence
  derived and/or modified sequence opt4 from anti-HIV_CDR
cagcagagcggcaccagccugcugacc

SEQ ID NO: 36476 - RNA, 27 nt, Artificial Sequence
  derived and/or modified sequence opt4 from anti-HIV_CDR
augaagagccagcacagccccagaacc

SEQ ID NO: 36477 - RNA, 27 nt, Artificial Sequence
  derived and/or modified sequence opt4 from anti-HIV_CDR
augcagccccugcagacccccuacacc

SEQ ID NO: 36478 - RNA, 27 nt, Artificial Sequence
  derived and/or modified sequence opt4 from anti-HIV_CDR
cagcaguacaccgccuaccccuggacc

SEQ ID NO: 36479 - RNA, 27 nt, Artificial Sequence
  derived and/or modified sequence opt4 from anti-HIV_CDR
cugcagaaccacaacuaccccagaacc

SEQ ID NO: 36480 - RNA, 27 nt, Artificial Sequence
  derived and/or modified sequence opt4 from anti-HIV_CDR
cugcagacccacagcuaccccagaacc

SEQ ID NO: 36481 - RNA, 30 nt, Artificial Sequence; identical to SEQ ID NO: 13555
  derived and/or modified sequence opt4 from anti-HIV_CDR

SEQ ID NO: 36482 - RNA, 30 nt, Artificial Sequence
  derived and/or modified sequence opt4 from anti-HIV_CDR
cagcacagcuucggcagcccccccuggacc

SEQ ID NO: 36483 - RNA, 30 nt, Artificial Sequence
  derived and/or modified sequence opt4 from anti-HIV_CDR
agcagcuucacccccaccaacacccuggug

SEQ ID NO: 36484 - RNA, 30 nt, Artificial Sequence
  derived and/or modified sequence opt4 from anti-HIV_CDR
cagcaguacggcacccugcaccccagaacc

SEQ ID NO: 36485 - RNA, 30 nt, Artificial Sequence; identical to SEQ ID NO: 21201
  derived and/or modified sequence opt4 from anti-HIV_CDR

SEQ ID NO: 36486 - RNA, 30 nt, Artificial Sequence; identical to SEQ ID NO: 13560
  derived and/or modified sequence opt4 from anti-HIV_CDR

SEQ ID NO: 36487 - RNA, 30 nt, Artificial Sequence
  derived and/or modified sequence opt4 from anti-HIV_CDR
cagcagagagccaacuggagacugcugacc

SEQ ID NO: 36488 - RNA, 30 nt, Artificial Sequence
  derived and/or modified sequence opt4 from anti-HIV_CDR
agacacagcgacuacugcgaccuggacgug

SEQ ID NO: 36489 - RNA, 30 nt, Artificial Sequence
  derived and/or modified sequence opt4 from anti-HIV_CDR
agaagaagcgacuacugcgacuucgacgug

SEQ ID NO: 36490 - RNA, 30 nt, Artificial Sequence
  derived and/or modified sequence opt4 from anti-HIV_CDR
agacacaccgacuacugcgacuucgacgug

SEQ ID NO: 36491 - RNA, 30 nt, Artificial Sequence
  derived and/or modified sequence opt4 from anti-HIV_CDR
cagagaagcgacuacugggacuucgacgug

SEQ ID NO: 36492 - RNA, 30 nt, Artificial Sequence
  derived and/or modified sequence opt4 from anti-HIV_CDR
agacacagcgacuacugcgacuucgacauc

SEQ ID NO: 36493 - RNA, 30 nt, Artificial Sequence; identical to SEQ ID NO: 13567
  derived and/or modified sequence opt4 from anti-HIV_CDR

SEQ ID NO: 36494 - RNA, 30 nt, Artificial Sequence; identical to SEQ ID NO: 13568
  derived and/or modified sequence opt4 from anti-HIV_CDR

SEQ ID NO: 36495 - RNA, 30 nt, Artificial Sequence
  derived and/or modified sequence opt4 from anti-HIV_CDR
cagagaagcgacuucugggacuucgacgug

SEQ ID NO: 36496 - RNA, 30 nt, Artificial Sequence
  derived and/or modified sequence opt4 from anti-HIV_CDR
agacacagcgacuacugcgacuucgacgug

SEQ ID NO: 36497 - RNA, 30 nt, Artificial Sequence
  derived and/or modified sequence opt4 from anti-HIV_CDR
ugcagcuacgccggcggcagaaccguggug

SEQ ID NO: 36498 - RNA, 30 nt, Artificial Sequence; identical to SEQ ID NO: 13572
  derived and/or modified sequence opt4 from anti-HIV_CDR

SEQ ID NO: 36499 - RNA, 30 nt, Artificial Sequence
  derived and/or modified sequence opt4 from anti-HIV_CDR
cagcagagaagcaacuggcccagacugacc

SEQ ID NO: 36500 - RNA, 30 nt, Artificial Sequence; identical to SEQ ID NO: 21216
  derived and/or modified sequence opt4 from anti-HIV_CDR

SEQ ID NO: 36501 - RNA, 30 nt, Artificial Sequence
  derived and/or modified sequence opt4 from anti-HIV_CDR
augcagggcaccuacuggcccccccugacc

SEQ ID NO: 36502 - RNA, 30 nt, Artificial Sequence
  derived and/or modified sequence opt4 from anti-HIV_CDR
cagcaguacggcagcagccugcuguacacc

SEQ ID NO: 36503 - RNA, 30 nt, Artificial Sequence
  derived and/or modified sequence opt4 from anti-HIV_CDR
cagcagagcuucggcaucccccccuggacc

SEQ ID NO: 36504 - RNA, 30 nt, Artificial Sequence
  derived and/or modified sequence opt4 from anti-HIV_CDR
ugcagcuacgccggcagcuacagcuacgug

SEQ ID NO: 36505 - RNA, 30 nt, Artificial Sequence
  derived and/or modified sequence opt4 from anti-HIV_CDR
uacagcuacgccggcaacagccugggcgug

SEQ ID NO: 36506 - RNA, 30 nt, Artificial Sequence
  derived and/or modified sequence opt4 from anti-HIV_CDR
agcagcuacaccaucagcagccccagagug

SEQ ID NO: 36507 - RNA, 30 nt, Artificial Sequence; identical to SEQ ID NO: 13581
  derived and/or modified sequence opt4 from anti-HIV_CDR

SEQ ID NO: 36508 - RNA, 30 nt, Artificial Sequence
  derived and/or modified sequence opt4 from anti-HIV_CDR
cugauccccgugagcggcgccuucgacgug

SEQ ID NO: 36509 - RNA, 30 nt, Artificial Sequence
  derived and/or modified sequence opt4 from anti-HIV_CDR
gacagagacuacgacgaggacuucgacuuc

SEQ ID NO: 36510 - RNA, 30 nt, Artificial Sequence
  derived and/or modified sequence opt4 from anti-HIV_CDR
caggaguacggcagaagcccccccuucccc

SEQ ID NO: 36511 - RNA, 30 nt, Artificial Sequence; identical to SEQ ID NO: 13585
  derived and/or modified sequence opt4 from anti-HIV_CDR

SEQ ID NO: 36512 - RNA, 30 nt, Artificial Sequence
  derived and/or modified sequence opt4 from anti-HIV_CDR
uucacccagagacagggcggcuucgacuac

SEQ ID NO: 36513 - RNA, 30 nt, Artificial Sequence; identical to SEQ ID NO: 21229
  derived and/or modified sequence opt4 from anti-HIV_CDR

SEQ ID NO: 36514 - RNA, 30 nt, Artificial Sequence
  derived and/or modified sequence opt4 from anti-HIV_CDR
cagcaguacggcagcagcgcccccuacacc

SEQ ID NO: 36515 - RNA, 30 nt, Artificial Sequence
  derived and/or modified sequence opt4 from anti-HIV_CDR
cagcagcugaacagcgacccccccuggacc

SEQ ID NO: 36516 - RNA, 30 nt, Artificial Sequence
  derived and/or modified sequence opt4 from anti-HIV_CDR
cagcaccacggcagcagccccaccuggacc

SEQ ID NO: 36517 - RNA, 30 nt, Artificial Sequence; identical to SEQ ID NO: 21233
  derived and/or modified sequence opt4 from anti-HIV_CDR

SEQ ID NO: 36518 - RNA, 30 nt, Artificial Sequence; identical to SEQ ID NO: 13592
  derived and/or modified sequence opt4 from anti-HIV_CDR

SEQ ID NO: 36519 - RNA, 30 nt, Artificial Sequence
  derived and/or modified sequence opt4 from anti-HIV_CDR
cagagcuacaacggcgacccccccgugacc

SEQ ID NO: 36520 - RNA, 30 nt, Artificial Sequence
  derived and/or modified sequence opt4 from anti-HIV_CDR
cagcaguacggcagcagcagaagauggacc

SEQ ID NO: 36521 - RNA, 30 nt, Artificial Sequence
  derived and/or modified sequence opt4 from anti-HIV_CDR
cagcaguucaacagcuaccccccccugacc

SEQ ID NO: 36522 - RNA, 30 nt, Artificial Sequence
  derived and/or modified sequence opt4 from anti-HIV_CDR
agagagggcagccagggcgccuucgacauc

SEQ ID NO: 36523 - RNA, 30 nt, Artificial Sequence
  derived and/or modified sequence opt4 from anti-HIV_CDR
ggcgacagcggccccaccggcuucgacuac

SEQ ID NO: 36524 - RNA, 30 nt, Artificial Sequence
  derived and/or modified sequence opt4 from anti-HIV_CDR
gugagaagaggcagcagcuaccccgacuac

SEQ ID NO: 36525 - RNA, 30 nt, Artificial Sequence
  derived and/or modified sequence opt4 from anti-HIV_CDR
agcgccuacuacagaaacugguucgacagc

SEQ ID NO: 36526 - RNA, 30 nt, Artificial Sequence
  derived and/or modified sequence opt4 from anti-HIV_CDR
cagagcuacgacagcagcgugagcguggug

SEQ ID NO: 36527 - RNA, 30 nt, Artificial Sequence
  derived and/or modified sequence opt4 from anti-HIV_CDR
agcagcuacaccagcagccugacccuggug

SEQ ID NO: 36528 - RNA, 30 nt, Artificial Sequence
  derived and/or modified sequence opt4 from anti-HIV_CDR
uacgagggcaagagaagcggcauggacgug

SEQ ID NO: 36529 - RNA, 30 nt, Artificial Sequence
  derived and/or modified sequence opt4 from anti-HIV_CDR
cagcaguacggcagcagccccgaguacacc

SEQ ID NO: 36530 - RNA, 30 nt, Artificial Sequence
  derived and/or modified sequence opt4 from anti-HIV_CDR
caguacuacgaccacagacccgccaucgcc

SEQ ID NO: 36531 - RNA, 30 nt, Artificial Sequence
  derived and/or modified sequence opt4 from anti-HIV_CDR
cagcaguacgacaaccugcccagagugacc

SEQ ID NO: 36532 - RNA, 30 nt, Artificial Sequence
  derived and/or modified sequence opt4 from anti-HIV_CDR
ggcgccuacaccaccaccagcacccuggug

SEQ ID NO: 36533 - RNA, 30 nt, Artificial Sequence
  derived and/or modified sequence opt4 from anti-HIV_CDR
cagcaguacaagagcuacagcccccugacc

SEQ ID NO: 36534 - RNA, 30 nt, Artificial Sequence
  derived and/or modified sequence opt4 from anti-HIV_CDR
cagcagagcuacaacaccagaccccugacc

SEQ ID NO: 36535 - RNA, 30 nt, Artificial Sequence
  derived and/or modified sequence opt4 from anti-HIV_CDR
cagcaguacggcggcagcccccccgacacc

SEQ ID NO: 36536 - RNA, 30 nt, Artificial Sequence
  derived and/or modified sequence opt4 from anti-HIV_CDR
ugcagcuacaccagcagcgccaccguggug

SEQ ID NO: 36537 - RNA, 30 nt, Artificial Sequence
  derived and/or modified sequence opt4 from anti-HIV_CDR
ugcagccacaccagcagcgacacccuggug

SEQ ID NO: 36538 - RNA, 30 nt, Artificial Sequence; identical to SEQ ID NO: 28896
  derived and/or modified sequence opt4 from anti-HIV_CDR

SEQ ID NO: 36539 - RNA, 30 nt, Artificial Sequence
  derived and/or modified sequence opt4 from anti-HIV_CDR
gacgccuucgugagcagcgccauggacgug

SEQ ID NO: 36540 - RNA, 30 nt, Artificial Sequence
  derived and/or modified sequence opt4 from anti-HIV_CDR
cugagagccaccacccccggcuucgacuac

SEQ ID NO: 36541 - RNA, 30 nt, Artificial Sequence; identical to SEQ ID NO: 28899
  derived and/or modified sequence opt4 from anti-HIV_CDR

SEQ ID NO: 36542 - RNA, 30 nt, Artificial Sequence
  derived and/or modified sequence opt4 from anti-HIV_CDR
cugagagccaccaucgccggcuucgacuac

SEQ ID NO: 36543 - RNA, 30 nt, Artificial Sequence
  derived and/or modified sequence opt4 from anti-HIV_CDR
ugcagcuacgccggcagcuacaucugggug

SEQ ID NO: 36544 - RNA, 30 nt, Artificial Sequence
  derived and/or modified sequence opt4 from anti-HIV_CDR
ugcagcuacgccggcaccuacagcuacgug

SEQ ID NO: 36545 - RNA, 30 nt, Artificial Sequence
  derived and/or modified sequence opt4 from anti-HIV_CDR
agcagcuacgccggcagcaacaacuucgug

SEQ ID NO: 36546 - RNA, 30 nt, Artificial Sequence
  derived and/or modified sequence opt4 from anti-HIV_CDR
ggcagcuucaccaccagccugacccuggug

SEQ ID NO: 36547 - RNA, 30 nt, Artificial Sequence
  derived and/or modified sequence opt4 from anti-HIV_CDR
cagcaguacgccaccagcagccuguacacc

SEQ ID NO: 36548 - RNA, 30 nt, Artificial Sequence
  derived and/or modified sequence opt4 from anti-HIV_CDR
cagugguacggcacccugcaccccagaacc

SEQ ID NO: 36549 - RNA, 30 nt, Artificial Sequence
  derived and/or modified sequence opt4 from anti-HIV_CDR
agcagcuacagcagcaccaacaccuacgug

SEQ ID NO: 36550 - RNA, 30 nt, Artificial Sequence
  derived and/or modified sequence opt4 from anti-HIV_CDR
accuucaucaccgccagcugguucgacagc

SEQ ID NO: 36551 - RNA, 30 nt, Artificial Sequence
  derived and/or modified sequence opt4 from anti-HIV_CDR
accggcggccugcugagauuccccgaggug

SEQ ID NO: 36552 - RNA, 30 nt, Artificial Sequence
  derived and/or modified sequence opt4 from anti-HIV_CDR
ugcagcuacgccggcagcuacaccuacgug

SEQ ID NO: 36553 - RNA, 30 nt, Artificial Sequence
  derived and/or modified sequence opt4 from anti-HIV_CDR
cagcagagauacagcuggcccagccugacc

SEQ ID NO: 36554 - RNA, 30 nt, Artificial Sequence
  derived and/or modified sequence opt4 from anti-HIV_CDR
cugcagugcggcagcagcccccccuacacc

SEQ ID NO: 36555 - RNA, 30 nt, Artificial Sequence
  derived and/or modified sequence opt4 from anti-HIV_CDR
agcagcuacgccggcaccaaccacugggug

SEQ ID NO: 36556 - RNA, 30 nt, Artificial Sequence
  derived and/or modified sequence opt4 from anti-HIV_CDR
agcagcuacgccgccaccaaccacugggug

SEQ ID NO: 36557 - RNA, 30 nt, Artificial Sequence
  derived and/or modified sequence opt4 from anti-HIV_CDR
caguacuacggcaccagcccccccagcacc

SEQ ID NO: 36558 - RNA, 30 nt, Artificial Sequence
  derived and/or modified sequence opt4 from anti-HIV_CDR
caguacuacggcagcagcccccccagcacc

SEQ ID NO: 36559 - RNA, 30 nt, Artificial Sequence
  derived and/or modified sequence opt4 from anti-HIV_CDR
caggaguucggcagagccccccccuacccc

SEQ ID NO: 36560 - RNA, 30 nt, Artificial Sequence
  derived and/or modified sequence opt4 from anti-HIV_CDR
caggaguacggcagaagcccccccuacccc

SEQ ID NO: 36561 - RNA, 30 nt, Artificial Sequence
  derived and/or modified sequence opt4 from anti-HIV_CDR
caggaguacggcagagccccccccuacccc

SEQ ID NO: 36562 - RNA, 30 nt, Artificial Sequence
  derived and/or modified sequence opt4 from anti-HIV_CDR
cacaucgccgugggcggcagcgaggagcac

SEQ ID NO: 36563 - RNA, 30 nt, Artificial Sequence
  derived and/or modified sequence opt4 from anti-HIV_CDR
cacaucgccgugggcggcagcgaggaccac

SEQ ID NO: 36564 - RNA, 30 nt, Artificial Sequence
  derived and/or modified sequence opt4 from anti-HIV_CDR
cacaucgccgugggcggcagagaggaggag

SEQ ID NO: 36565 - RNA, 33 nt, Artificial Sequence
  derived and/or modified sequence opt4 from anti-HIV_CDR
ggcgagaagagcagaggcagcagagccgugcag

SEQ ID NO: 36566 - RNA, 33 nt, Artificial Sequence
  derived and/or modified sequence opt4 from anti-HIV_CDR
ggcgagaagagcuucgccagcagagccgugcag

SEQ ID NO: 36567 - RNA, 33 nt, Artificial Sequence
  derived and/or modified sequence opt4 from anti-HIV_CDR
ggcagacaggcccugggcagcagagccgugcag

SEQ ID NO: 36568 - RNA, 33 nt, Artificial Sequence
  derived and/or modified sequence opt4 from anti-HIV_CDR
ggcgaggagagccugggcagcagaagcgugauc

SEQ ID NO: 36569 - RNA, 33 nt, Artificial Sequence
  derived and/or modified sequence opt4 from anti-HIV_CDR
ggcgagaagagccugggcagcagagccgugcag

SEQ ID NO: 36570 - RNA, 33 nt, Artificial Sequence
  derived and/or modified sequence opt4 from anti-HIV_CDR
ggcaaggagagcaucggcagcagagccgugcag

SEQ ID NO: 36571 - RNA, 33 nt, Artificial Sequence
  derived and/or modified sequence opt4 from anti-HIV_CDR
ggcggcaacaacaucggcagcaagagcgugcac

SEQ ID NO: 36572 - RNA, 33 nt, Artificial Sequence
  derived and/or modified sequence opt4 from anti-HIV_CDR
ggcgagaagagcaucggcagcagagccgugcag

SEQ ID NO: 36573 - RNA, 33 nt, Artificial Sequence
  derived and/or modified sequence opt4 from anti-HIV_CDR
aaggccagccaggacgugagcaccgccguggcc

SEQ ID NO: 36574 - RNA, 33 nt, Artificial Sequence
  derived and/or modified sequence opt4 from anti-HIV_CDR
ggcagcagaaaccugagccacagacugcugagc

SEQ ID NO: 36575 - RNA, 33 nt, Artificial Sequence
  derived and/or modified sequence opt4 from anti-HIV_CDR
ggcaccuacgacagccagggcagcaccagacug

SEQ ID NO: 36576 - RNA, 33 nt, Artificial Sequence
  derived and/or modified sequence opt4 from anti-HIV_CDR
cagcagagaaccaucuggccccccggcugcagc

SEQ ID NO: 36577 - RNA, 33 nt, Artificial Sequence
  derived and/or modified sequence opt4 from anti-HIV_CDR
ggcaccugggacagcagccugagcgccgugcug

SEQ ID NO: 36578 - RNA, 33 nt, Artificial Sequence
  derived and/or modified sequence opt4 from anti-HIV_CDR
gccagcugggacaacagccugagcggccccgug

SEQ ID NO: 36579 - RNA, 33 nt, Artificial Sequence
  derived and/or modified sequence opt4 from anti-HIV_CDR
gccagcugggacgacagccugagcggcugggug

SEQ ID NO: 36580 - RNA, 33 nt, Artificial Sequence
  derived and/or modified sequence opt4 from anti-HIV_CDR
cugcugcugcccuacuacggcggccccuggauc

SEQ ID NO: 36581 - RNA, 33 nt, Artificial Sequence
  derived and/or modified sequence opt4 from anti-HIV_CDR
cagcacagaaccaacuggccccccagcaucacc

SEQ ID NO: 36582 - RNA, 33 nt, Artificial Sequence
  derived and/or modified sequence opt4 from anti-HIV_CDR
cagagcuacgacagaagccugagaggcagcgug

SEQ ID NO: 36583 - RNA, 33 nt, Artificial Sequence
  derived and/or modified sequence opt4 from anti-HIV_CDR
agcagcggcaacuacgacuucgccuucgacauc

SEQ ID NO: 36584 - RNA, 33 nt, Artificial Sequence
  derived and/or modified sequence opt4 from anti-HIV_CDR
agcagcggcaacuacgacuucgccuacgacauc

SEQ ID NO: 36585 - RNA, 33 nt, Artificial Sequence
  derived and/or modified sequence opt4 from anti-HIV_CDR
agcagcggcaacuucgaguucgccuucgagauc

SEQ ID NO: 36586 - RNA, 33 nt, Artificial Sequence
  derived and/or modified sequence opt4 from anti-HIV_CDR
gccaccuacgacagccacggcagcaucagacug

SEQ ID NO: 36587 - RNA, 33 nt, Artificial Sequence
  derived and/or modified sequence opt4 from anti-HIV_CDR
ggcaccuacgacaccagccugagccugagacug

SEQ ID NO: 36588 - RNA, 33 nt, Artificial Sequence
  derived and/or modified sequence opt4 from anti-HIV_CDR
gccgccuucgacagcgcccugagccugccccug

SEQ ID NO: 36589 - RNA, 33 nt, Artificial Sequence
  derived and/or modified sequence opt4 from anti-HIV_CDR
gccaccuacgacagcgacggcagcaucagacug

SEQ ID NO: 36590 - RNA, 33 nt, Artificial Sequence
  derived and/or modified sequence opt4 from anti-HIV_CDR
gccaccuacgacagcggcuggagcaucagacug

SEQ ID NO: 36591 - RNA, 33 nt, Artificial Sequence
  derived and/or modified sequence opt4 from anti-HIV_CDR
gccaccuacgacaccggccugagccugagacug

SEQ ID NO: 36592 - RNA, 33 nt, Artificial Sequence
  derived and/or modified sequence opt4 from anti-HIV_CDR
gccgccuacgacagcacccugagccugagacug

SEQ ID NO: 36593 - RNA, 33 nt, Artificial Sequence
  derived and/or modified sequence opt4 from anti-HIV_CDR
gccgccuacgacagcgccgugagccugcccgug

SEQ ID NO: 36594 - RNA, 33 nt, Artificial Sequence
  derived and/or modified sequence opt4 from anti-HIV_CDR
gccaccuacgacaccgaccugagccugagacug

SEQ ID NO: 36595 - RNA, 33 nt, Artificial Sequence
  derived and/or modified sequence opt4 from anti-HIV_CDR
gccgccuacgacagcagccugagccugagacug

SEQ ID NO: 36596 - RNA, 33 nt, Artificial Sequence
  derived and/or modified sequence opt4 from anti-HIV_CDR
gccgccuacgacagcaccuucagccugcccgug

SEQ ID NO: 36597 - RNA, 33 nt, Artificial Sequence
  derived and/or modified sequence opt4 from anti-HIV_CDR
gccaccuacgacagccagggcagcaccagacug

SEQ ID NO: 36598 - RNA, 33 nt, Artificial Sequence
  derived and/or modified sequence opt4 from anti-HIV_CDR
gccaccuacgacagccagagaagcaucagacug

SEQ ID NO: 36599 - RNA, 33 nt, Artificial Sequence
  derived and/or modified sequence opt4 from anti-HIV_CDR
gccguguacgacagcagccugagccugggccug

SEQ ID NO: 36600 - RNA, 33 nt, Artificial Sequence; identical to SEQ ID NO: 28958
  derived and/or modified sequence opt4 from anti-HIV_CDR

SEQ ID NO: 36601 - RNA, 33 nt, Artificial Sequence; identical to SEQ ID NO: 28959
  derived and/or modified sequence opt4 from anti-HIV_CDR

SEQ ID NO: 36602 - RNA, 33 nt, Artificial Sequence
  derived and/or modified sequence opt4 from anti-HIV_CDR
ugcgagguggacgccgacgagaccgugaccugc

SEQ ID NO: 36603 - RNA, 33 nt, Artificial Sequence
  derived and/or modified sequence opt4 from anti-HIV_CDR
ugcgagguggacgccgaggugaccaugaccgug

SEQ ID NO: 36604 - RNA, 33 nt, Artificial Sequence
  derived and/or modified sequence opt4 from anti-HIV_CDR
agcagcuacgccgacaccaacgacuucggcgug

SEQ ID NO: 36605 - RNA, 33 nt, Artificial Sequence; identical to SEQ ID NO: 13679
  derived and/or modified sequence opt4 from anti-HIV_CDR

SEQ ID NO: 36606 - RNA, 33 nt, Artificial Sequence
  derived and/or modified sequence opt4 from anti-HIV_CDR
ggcaccugggacggcagccugaccaccggcgug

SEQ ID NO: 36607 - RNA, 33 nt, Artificial Sequence
  derived and/or modified sequence opt4 from anti-HIV_CDR
cagagcuacgacaacagccugagcggcugggug

SEQ ID NO: 36608 - RNA, 33 nt, Artificial Sequence
  derived and/or modified sequence opt4 from anti-HIV_CDR
cagcaguacuacagcaucccccccuggaccuuc

SEQ ID NO: 36609 - RNA, 33 nt, Artificial Sequence
  derived and/or modified sequence opt4 from anti-HIV_CDR
augcagggcaccuacuggccccccagcaucacc

SEQ ID NO: 36610 - RNA, 33 nt, Artificial Sequence
  derived and/or modified sequence opt4 from anti-HIV_CDR
cagagcuacgacagcagccugggcguggaggug

SEQ ID NO: 36611 - RNA, 33 nt, Artificial Sequence
  derived and/or modified sequence opt4 from anti-HIV_CDR
caggugugggacagcggcagagacagcugggug

SEQ ID NO: 36612 - RNA, 33 nt, Artificial Sequence
  derived and/or modified sequence opt4 from anti-HIV_CDR
cagagcuacgacagcagccugagcggcugggug

SEQ ID NO: 36613 - RNA, 33 nt, Artificial Sequence
  derived and/or modified sequence opt4 from anti-HIV_CDR
ggcagcugggacggcagccugaacgccggcgug

SEQ ID NO: 36614 - RNA, 33 nt, Artificial Sequence
  derived and/or modified sequence opt4 from anti-HIV_CDR
cugagcgccgacagcagcagcaccuaccaggug

SEQ ID NO: 36615 - RNA, 33 nt, Artificial Sequence
  derived and/or modified sequence opt4 from anti-HIV_CDR
ugcagcuacgccggcagagacaccagcugggug

SEQ ID NO: 36616 - RNA, 33 nt, Artificial Sequence
  derived and/or modified sequence opt4 from anti-HIV_CDR
cagcagagaagcaacuggccccccggccugacc

SEQ ID NO: 36617 - RNA, 33 nt, Artificial Sequence
  derived and/or modified sequence opt4 from anti-HIV_CDR
aagggcagaggcuacggcuacugguucgacagc

SEQ ID NO: 36618 - RNA, 33 nt, Artificial Sequence
  derived and/or modified sequence opt4 from anti-HIV_CDR
gagauggccgccaccagcgacgccuucgacauc

SEQ ID NO: 36619 - RNA, 33 nt, Artificial Sequence
  derived and/or modified sequence opt4 from anti-HIV_CDR
agcaucuacagcaccggccccgcccccguguac

SEQ ID NO: 36620 - RNA, 33 nt, Artificial Sequence
  derived and/or modified sequence opt4 from anti-HIV_CDR
agaggcagccugcugaucaaguacuucgacuac

SEQ ID NO: 36621 - RNA, 33 nt, Artificial Sequence
  derived and/or modified sequence opt4 from anti-HIV_CDR
cagcaguacgacaaccugccccccagagugacc

SEQ ID NO: 36622 - RNA, 33 nt, Artificial Sequence
  derived and/or modified sequence opt4 from anti-HIV_CDR
gacgugagacugguggccgugcccggcgccgac

SEQ ID NO: 36623 - RNA, 33 nt, Artificial Sequence
  derived and/or modified sequence opt4 from anti-HIV_CDR
cagcagagaaccaccuggccccccgaguacacc

SEQ ID NO: 36624 - RNA, 33 nt, Artificial Sequence; identical to SEQ ID NO: 13698
  derived and/or modified sequence opt4 from anti-HIV_CDR

SEQ ID NO: 36625 - RNA, 33 nt, Artificial Sequence
  derived and/or modified sequence opt4 from anti-HIV_CDR
agaagaagaagcgccuggagccccuucgacagc

SEQ ID NO: 36626 - RNA, 33 nt, Artificial Sequence
  derived and/or modified sequence opt4 from anti-HIV_CDR
gccaccugggacagcagccugagaaccgcccug

SEQ ID NO: 36627 - RNA, 33 nt, Artificial Sequence
  derived and/or modified sequence opt4 from anti-HIV_CDR
ggcaccugggacagcagccugagagccgcccug

SEQ ID NO: 36628 - RNA, 33 nt, Artificial Sequence
  derived and/or modified sequence opt4 from anti-HIV_CDR
cagcagagaagcaucuggccccccagccugacc

SEQ ID NO: 36629 - RNA, 33 nt, Artificial Sequence
  derived and/or modified sequence opt4 from anti-HIV_CDR
gaguuccagaccagcggcguggugagagagggc

SEQ ID NO: 36630 - RNA, 33 nt, Artificial Sequence
  derived and/or modified sequence opt4 from anti-HIV_CDR
cacaucggcgccggcggccccuacagcgaguac

SEQ ID NO: 36631 - RNA, 33 nt, Artificial Sequence
  derived and/or modified sequence opt4 from anti-HIV_CDR
agaggccacagcuucaccagccccuucgacagc

SEQ ID NO: 36632 - RNA, 33 nt, Artificial Sequence
  derived and/or modified sequence opt4 from anti-HIV_CDR
cagcaccugaacagcuaccccagaauguacacc

SEQ ID NO: 36633 - RNA, 33 nt, Artificial Sequence
  derived and/or modified sequence opt4 from anti-HIV_CDR
cagcagagaagcaacuggccccccaagaucacc

SEQ ID NO: 36634 - RNA, 33 nt, Artificial Sequence
  derived and/or modified sequence opt4 from anti-HIV_CDR
gccgccugggacgacagccugggcggcguggug

SEQ ID NO: 36635 - RNA, 33 nt, Artificial Sequence
  derived and/or modified sequence opt4 from anti-HIV_CDR
ggcaccugggacagcagccugagcgccguggug

SEQ ID NO: 36636 - RNA, 33 nt, Artificial Sequence
  derived and/or modified sequence opt4 from anti-HIV_CDR
cagcagagagccaacuggccccccggcggcacc

SEQ ID NO: 36637 - RNA, 33 nt, Artificial Sequence
  derived and/or modified sequence opt4 from anti-HIV_CDR
ggcggcggcuaccccagaggcaacauggacgug

SEQ ID NO: 36638 - RNA, 33 nt, Artificial Sequence
  derived and/or modified sequence opt4 from anti-HIV_CDR
cugcugcugcuguacuacggcggccccuggauc

SEQ ID NO: 36639 - RNA, 33 nt, Artificial Sequence
  derived and/or modified sequence opt4 from anti-HIV_CDR
cagcagagaggcaucuggccccugcagaucacc

SEQ ID NO: 36640 - RNA, 33 nt, Artificial Sequence
  derived and/or modified sequence opt4 from anti-HIV_CDR
agaagccccggcggcggcuacgccuucgacauc

SEQ ID NO: 36641 - RNA, 33 nt, Artificial Sequence
  derived and/or modified sequence opt4 from anti-HIV_CDR
agcggccccggccugcugagaggcuucgacuac

SEQ ID NO: 36642 - RNA, 33 nt, Artificial Sequence
  derived and/or modified sequence opt4 from anti-HIV_CDR
cagcagagaaccaccagaccccccgaguacacc

SEQ ID NO: 36643 - RNA, 33 nt, Artificial Sequence
  derived and/or modified sequence opt4 from anti-HIV_CDR
cagcagagaaccaccagaccccccgacuacacc

SEQ ID NO: 36644 - RNA, 33 nt, Artificial Sequence
  derived and/or modified sequence opt4 from anti-HIV_CDR
cagggcagaaccaccagaccccccgacuacacc

SEQ ID NO: 36645 - RNA, 33 nt, Artificial Sequence
  derived and/or modified sequence opt4 from anti-HIV_CDR
cagcagagaagcaccaccccccccgaguacacc

SEQ ID NO: 36646 - RNA, 33 nt, Artificial Sequence
  derived and/or modified sequence opt4 from anti-HIV_CDR
cagcagagaaccagcuggccccuggcccugagc

SEQ ID NO: 36647 - RNA, 33 nt, Artificial Sequence
  derived and/or modified sequence opt4 from anti-HIV_CDR
agaggccacagcuucagccugcccuucgacagc

SEQ ID NO: 36648 - RNA, 36 nt, Artificial Sequence
  derived and/or modified sequence opt4 from anti-HIV_CDR
cacuacugggacagcagaagccccaucagcugggug

SEQ ID NO: 36649 - RNA, 36 nt, Artificial Sequence
  derived and/or modified sequence opt4 from anti-HIV_CDR
cacaagugggacagcagaagcccccugagcugggug

SEQ ID NO: 36650 - RNA, 36 nt, Artificial Sequence
  derived and/or modified sequence opt4 from anti-HIV_CDR
cacaugugggacagcagaagcggcuucagcuggagc

SEQ ID NO: 36651 - RNA, 36 nt, Artificial Sequence
  derived and/or modified sequence opt4 from anti-HIV_CDR
cacaucugggacagcagagugcccaccaagugggug

SEQ ID NO: 36652 - RNA, 36 nt, Artificial Sequence
  derived and/or modified sequence opt4 from anti-HIV_CDR
caggugugggacagcagcagcgaccaccccugggug

SEQ ID NO: 36653 - RNA, 36 nt, Artificial Sequence
  derived and/or modified sequence opt4 from anti-HIV_CDR
cacaucuacgacgccagaagacccaccaacugggug

SEQ ID NO: 36654 - RNA, 36 nt, Artificial Sequence
  derived and/or modified sequence opt4 from anti-HIV_CDR
cuggacggcgaggccuucagauacuaccuggaccug

SEQ ID NO: 36655 - RNA, 36 nt, Artificial Sequence
  derived and/or modified sequence opt4 from anti-HIV_CDR
ccccaguacaaccugggcagagacccccuggacgug

SEQ ID NO: 36656 - RNA, 36 nt, Artificial Sequence
  derived and/or modified sequence opt4 from anti-HIV_CDR
cccgagcccagcagcaucguggccccccuguacuac

SEQ ID NO: 36657 - RNA, 36 nt, Artificial Sequence
  derived and/or modified sequence opt4 from anti-HIV_CDR
ggcggcggcgacggcagaaacuggcaccugcacccc

SEQ ID NO: 36658 - RNA, 36 nt, Artificial Sequence
  derived and/or modified sequence opt4 from anti-HIV_CDR
cccaagagcggcagagacuacuggagcuucgaccug

SEQ ID NO: 36659 - RNA, 36 nt, Artificial Sequence
  derived and/or modified sequence opt4 from anti-HIV_CDR
cccagaggcggcagagacaacuggagcuuccacgug

SEQ ID NO: 36660 - RNA, 36 nt, Artificial Sequence
  derived and/or modified sequence opt4 from anti-HIV_CDR
ccccacagccccgacgacgccuggagccuggacgug

SEQ ID NO: 36661 - RNA, 36 nt, Artificial Sequence
  derived and/or modified sequence opt4 from anti-HIV_CDR
ccccugagaggcggcgacaccuggcacuaccacagc

SEQ ID NO: 36662 - RNA, 36 nt, Artificial Sequence
  derived and/or modified sequence opt4 from anti-HIV_CDR
cugcagcccguguacauccugagaagcaucugccac

SEQ ID NO: 36663 - RNA, 36 nt, Artificial Sequence
  derived and/or modified sequence opt4 from anti-HIV_CDR
cugcagcccguguacauccugaagugcaacuggugc

SEQ ID NO: 36664 - RNA, 36 nt, Artificial Sequence
  derived and/or modified sequence opt4 from anti-HIV_CDR
gaguacagauucgacgacuggggcccccuggaccac

SEQ ID NO: 36665 - RNA, 36 nt, Artificial Sequence
  derived and/or modified sequence opt4 from anti-HIV_CDR
gccgccugggacgacagccugaacggccacggcgug

SEQ ID NO: 36666 - RNA, 36 nt, Artificial Sequence; identical to SEQ ID NO: 13740
  derived and/or modified sequence opt4 from anti-HIV_CDR

SEQ ID NO: 36667 - RNA, 36 nt, Artificial Sequence
  derived and/or modified sequence opt4 from anti-HIV_CDR
ggccuguacgacagcagcggcuacuacuucggcuac

SEQ ID NO: 36668 - RNA, 36 nt, Artificial Sequence
  derived and/or modified sequence opt4 from anti-HIV_CDR
cugggcugcagcggcggcagcugcuacgaggacagc

SEQ ID NO: 36669 - RNA, 36 nt, Artificial Sequence
  derived and/or modified sequence opt4 from anti-HIV_CDR
gccagcggcagcuacauccugggcaccauggacgug

SEQ ID NO: 36670 - RNA, 36 nt, Artificial Sequence
  derived and/or modified sequence opt4 from anti-HIV_CDR
uacagcaccgacaacagcggcaagcagcacugggug

SEQ ID NO: 36671 - RNA, 36 nt, Artificial Sequence
  derived and/or modified sequence opt4 from anti-HIV_CDR
gugaagcaguuccuggaguggcuguaccuggacuac

SEQ ID NO: 36672 - RNA, 36 nt, Artificial Sequence
  derived and/or modified sequence opt4 from anti-HIV_CDR
ggcgugagaagcaucgugggcgcccacuucgacuac

SEQ ID NO: 36673 - RNA, 36 nt, Artificial Sequence
  derived and/or modified sequence opt4 from anti-HIV_CDR
ggcgugggcaccagauacuacguguacuucgacagc

SEQ ID NO: 36674 - RNA, 36 nt, Artificial Sequence
  derived and/or modified sequence opt4 from anti-HIV_CDR
gcccccuacaucagcagcagccaccuggacuacugg

SEQ ID NO: 36675 - RNA, 36 nt, Artificial Sequence
  derived and/or modified sequence opt4 from anti-HIV_CDR
agaggcaucgccgccgccggcuucuacuuccagcac

SEQ ID NO: 36676 - RNA, 36 nt, Artificial Sequence
  derived and/or modified sequence opt4 from anti-HIV_CDR
agaggcaucgccgccgccgccuucuacuuccagacc

SEQ ID NO: 36677 - RNA, 36 nt, Artificial Sequence
  derived and/or modified sequence opt4 from anti-HIV_CDR
agaggcaucgccgccgccggcuucuacuuccagaac

SEQ ID NO: 36678 - RNA, 36 nt, Artificial Sequence
  derived and/or modified sequence opt4 from anti-HIV_CDR
cagagcuacgacaccagccugaccgacaccggcgug

SEQ ID NO: 36679 - RNA, 36 nt, Artificial Sequence
  derived and/or modified sequence opt4 from anti-HIV_CDR
cagagcuacgacaccagccugagcgacaccggcgug

SEQ ID NO: 36680 - RNA, 36 nt, Artificial Sequence
  derived and/or modified sequence opt4 from anti-HIV_CDR
agaaccacccuggugaacuucggcguguucgaccug

SEQ ID NO: 36681 - RNA, 36 nt, Artificial Sequence
  derived and/or modified sequence opt4 from anti-HIV_CDR
cccguggugaacaccauccugcccuacugcgacgug

SEQ ID NO: 36682 - RNA, 36 nt, Artificial Sequence
  derived and/or modified sequence opt4 from anti-HIV_CDR
ugcuacagcggcagaagcagauacuucuucgacagc

SEQ ID NO: 36683 - RNA, 36 nt, Artificial Sequence; identical to SEQ ID NO: 13757
  derived and/or modified sequence opt4 from anti-HIV_CDR

SEQ ID NO: 36684 - RNA, 36 nt, Artificial Sequence
  derived and/or modified sequence opt4 from anti-HIV_CDR
cugagaagaggcuacuacgacagcggcgaggacuac

SEQ ID NO: 36685 - RNA, 36 nt, Artificial Sequence
  derived and/or modified sequence opt4 from anti-HIV_CDR
cugagaagaggcuacuucgacagcggcggcgaccac

SEQ ID NO: 36686 - RNA, 36 nt, Artificial Sequence
  derived and/or modified sequence opt4 from anti-HIV_CDR
agcagcuacaccagcagcagcacccugggcguggug

SEQ ID NO: 36687 - RNA, 36 nt, Artificial Sequence
  derived and/or modified sequence opt4 from anti-HIV_CDR
cuggacggcgaggccuucagauacuacuucgacagc

SEQ ID NO: 36688 - RNA, 36 nt, Artificial Sequence
  derived and/or modified sequence opt4 from anti-HIV_CDR
agaagaggccagagacugcuggccuacuucgacuac

SEQ ID NO: 36689 - RNA, 36 nt, Artificial Sequence
  derived and/or modified sequence opt4 from anti-HIV_CDR
ccccaguacaaccugggcagagagccccugaacgug

SEQ ID NO: 36690 - RNA, 36 nt, Artificial Sequence
  derived and/or modified sequence opt4 from anti-HIV_CDR
gcccaccacgacuucuggagagcccccguggacgug

SEQ ID NO: 36691 - RNA, 36 nt, Artificial Sequence
  derived and/or modified sequence opt4 from anti-HIV_CDR
ggcagaagagagggccugaacuuccugcuggacuac

SEQ ID NO: 36692 - RNA, 36 nt, Artificial Sequence
  derived and/or modified sequence opt4 from anti-HIV_CDR
cccgagcccagcagcaucgugggcgcccuguacuac

SEQ ID NO: 36693 - RNA, 36 nt, Artificial Sequence
  derived and/or modified sequence opt4 from anti-HIV_CDR
ggccccgacgacuucuggagcggcuaccccaaguac

SEQ ID NO: 36694 - RNA, 36 nt, Artificial Sequence
  derived and/or modified sequence opt4 from anti-HIV_CDR
gacuacagcgccgccggcagacaccuguucgacagc

SEQ ID NO: 36695 - RNA, 36 nt, Artificial Sequence
  derived and/or modified sequence opt4 from anti-HIV_CDR
gacuacaccgccagaggcagacacuucuucgacuac

SEQ ID NO: 36696 - RNA, 36 nt, Artificial Sequence
  derived and/or modified sequence opt4 from anti-HIV_CDR
gacuacaccgccagcggcagacacuucuucgacuac

SEQ ID NO: 36697 - RNA, 36 nt, Artificial Sequence
  derived and/or modified sequence opt4 from anti-HIV_CDR
cagagcuacgacagcagccugagcggcagcugggug

SEQ ID NO: 36698 - RNA, 36 nt, Artificial Sequence
  derived and/or modified sequence opt4 from anti-HIV_CDR
cccgcccaggccggcgugggccccagauucgacuac

SEQ ID NO: 36699 - RNA, 36 nt, Artificial Sequence
  derived and/or modified sequence opt4 from anti-HIV_CDR
ggcgccaucaacagcagcccccuguacuucgacagc

SEQ ID NO: 36700 - RNA, 36 nt, Artificial Sequence
  derived and/or modified sequence opt4 from anti-HIV_CDR
ggcgacaucaccagcagcccccuguacuucgacuuc

SEQ ID NO: 36701 - RNA, 36 nt, Artificial Sequence
  derived and/or modified sequence opt4 from anti-HIV_CDR
ggcgccaucaacagcagccccagcuacuucgacagc

SEQ ID NO: 36702 - RNA, 36 nt, Artificial Sequence
  derived and/or modified sequence opt4 from anti-HIV_CDR
uggguggugaccgccgccgaggaguacuucgacuac

SEQ ID NO: 36703 - RNA, 39 nt, Artificial Sequence
  derived and/or modified sequence opt4 from anti-HIV_CDR
gacccccagguggaggugagaggcaacgccuucgacauc

SEQ ID NO: 36704 - RNA, 39 nt, Artificial Sequence
  derived and/or modified sequence opt4 from anti-HIV_CDR
gaccacggcgaccccagaaccggcuacuacuucgacuac

SEQ ID NO: 36705 - RNA, 39 nt, Artificial Sequence
  derived and/or modified sequence opt4 from anti-HIV_CDR
gacgagagcggcuacgaccugaacuggcaccuggacagc

SEQ ID NO: 36706 - RNA, 39 nt, Artificial Sequence
  derived and/or modified sequence opt4 from anti-HIV_CDR
gacggcagcggcgacgacagaaacuggcaccuggacccc

SEQ ID NO: 36707 - RNA, 39 nt, Artificial Sequence
  derived and/or modified sequence opt4 from anti-HIV_CDR
gacagaagagacgacggccuggacuggcugcuggacccc

SEQ ID NO: 36708 - RNA, 39 nt, Artificial Sequence
  derived and/or modified sequence opt4 from anti-HIV_CDR
gacggcggcggcgacgacagaaccuggcugcuggacgcc

SEQ ID NO: 36709 - RNA, 39 nt, Artificial Sequence
  derived and/or modified sequence opt4 from anti-HIV_CDR
gacggcagcggcgacgccagagacuggcaccugcacccc

SEQ ID NO: 36710 - RNA, 39 nt, Artificial Sequence
  derived and/or modified sequence opt4 from anti-HIV_CDR
gacggcagcggcgacgacaccagcugguaccuggacccc

SEQ ID NO: 36711 - RNA, 39 nt, Artificial Sequence
  derived and/or modified sequence opt4 from anti-HIV_CDR
gacggcagcggcgacgacaccagcuggcaccuggacccc

SEQ ID NO: 36712 - RNA, 39 nt, Artificial Sequence
  derived and/or modified sequence opt4 from anti-HIV_CDR
gacagaagagacgacgacagagccuggcugcuggacccc

SEQ ID NO: 36713 - RNA, 39 nt, Artificial Sequence
  derived and/or modified sequence opt4 from anti-HIV_CDR
gacggcagcggcgacgccagagacuggcaccuggacccc

SEQ ID NO: 36714 - RNA, 39 nt, Artificial Sequence
  derived and/or modified sequence opt4 from anti-HIV_CDR
gacggcagcggcgacgccaccagcuggcaccugcacccc

SEQ ID NO: 36715 - RNA, 39 nt, Artificial Sequence
  derived and/or modified sequence opt4 from anti-HIV_CDR
gacgagagcggcgacgaccugaaguggcaccugcacccc

SEQ ID NO: 36716 - RNA, 39 nt, Artificial Sequence
  derived and/or modified sequence opt4 from anti-HIV_CDR
gacggcagcggcgacgacaccagcuggcaccugcacccc

SEQ ID NO: 36717 - RNA, 39 nt, Artificial Sequence
  derived and/or modified sequence opt4 from anti-HIV_CDR
gcccagggcgacauccugaccgagggcuacuucgacuac

SEQ ID NO: 36718 - RNA, 39 nt, Artificial Sequence
  derived and/or modified sequence opt4 from anti-HIV_CDR
gacagaauguucuggcagcagcuggccaaguacgacagc

SEQ ID NO: 36719 - RNA, 39 nt, Artificial Sequence
  derived and/or modified sequence opt4 from anti-HIV_CDR
agcaccugggacuacagccugagcgcccacgaggacgug

SEQ ID NO: 36720 - RNA, 39 nt, Artificial Sequence
  derived and/or modified sequence opt4 from anti-HIV_CDR
gccgccugggacgacagccugagcggccugaacugggug

SEQ ID NO: 36721 - RNA, 39 nt, Artificial Sequence
  derived and/or modified sequence opt4 from anti-HIV_CDR
cugagcagcgacagaaucgugguggugggccccgacuac

SEQ ID NO: 36722 - RNA, 39 nt, Artificial Sequence
  derived and/or modified sequence opt4 from anti-HIV_CDR
gaggccggcagcgugaccgccaccggccccuucgacagc

SEQ ID NO: 36723 - RNA, 39 nt, Artificial Sequence
  derived and/or modified sequence opt4 from anti-HIV_CDR
gacuucggcagagccuacgccaucggcuacuucgaguac

SEQ ID NO: 36724 - RNA, 39 nt, Artificial Sequence
  derived and/or modified sequence opt4 from anti-HIV_CDR
gacagagcccccuacggcgccuucgagcccuucgacuuc

SEQ ID NO: 36725 - RNA, 39 nt, Artificial Sequence
  derived and/or modified sequence opt4 from anti-HIV_CDR
aacggccacagcagccugggcggcggcuacuucccccac

SEQ ID NO: 36726 - RNA, 39 nt, Artificial Sequence
  derived and/or modified sequence opt4 from anti-HIV_CDR
aacggccacagcgcccugggcggcgaguacuuccagcac

SEQ ID NO: 36727 - RNA, 39 nt, Artificial Sequence
  derived and/or modified sequence opt4 from anti-HIV_CDR
gccgccagaagagccuucuacuacuacuacauggacgug

SEQ ID NO: 36728 - RNA, 39 nt, Artificial Sequence
  derived and/or modified sequence opt4 from anti-HIV_CDR
gccaacuacuacgacagcagcggcuacggccuggacauc

SEQ ID NO: 36729 - RNA, 39 nt, Artificial Sequence
  derived and/or modified sequence opt4 from anti-HIV_CDR
cacagcagacccggcgcccccccccacuacuucgacuac

SEQ ID NO: 36730 - RNA, 39 nt, Artificial Sequence
  derived and/or modified sequence opt4 from anti-HIV_CDR
ggccugaccguggccacccuguacgacgccuucgacgug

SEQ ID NO: 36731 - RNA, 39 nt, Artificial Sequence
  derived and/or modified sequence opt4 from anti-HIV_CDR
agagacagauacaacuggaaguacuacuaccuggacgug

SEQ ID NO: 36732 - RNA, 39 nt, Artificial Sequence
  derived and/or modified sequence opt4 from anti-HIV_CDR
gacagaggcagcagcggcugguacggcuggcuggacccc

SEQ ID NO: 36733 - RNA, 39 nt, Artificial Sequence
  derived and/or modified sequence opt4 from anti-HIV_CDR
gacagacugagcagcuucuggagcggcggcaucgaccag

SEQ ID NO: 36734 - RNA, 39 nt, Artificial Sequence
  derived and/or modified sequence opt4 from anti-HIV_CDR
gacgugaucgugggcgcccugcugggcgccuucgacauc

SEQ ID NO: 36735 - RNA, 39 nt, Artificial Sequence
  derived and/or modified sequence opt4 from anti-HIV_CDR
caccugaucgcccccaccgccggcaacuacuucuacccc

SEQ ID NO: 36736 - RNA, 39 nt, Artificial Sequence
  derived and/or modified sequence opt4 from anti-HIV_CDR
gacagcagaccccaggcccugguggccgcccuggacgug

SEQ ID NO: 36737 - RNA, 39 nt, Artificial Sequence
  derived and/or modified sequence opt4 from anti-HIV_CDR
gacgagaucgugggcgcccugcugggcgccuucgacauc

SEQ ID NO: 36738 - RNA, 39 nt, Artificial Sequence
  derived and/or modified sequence opt4 from anti-HIV_CDR
agcgaccccgccaucgccgccgccggcagccuggaccug

SEQ ID NO: 36739 - RNA, 39 nt, Artificial Sequence
  derived and/or modified sequence opt4 from anti-HIV_CDR
cccuacgugcagaccguggccaccaccaccuucgacuuc

SEQ ID NO: 36740 - RNA, 39 nt, Artificial Sequence
  derived and/or modified sequence opt4 from anti-HIV_CDR
ggccccaagagcguggccagccugagcuacuucgacaag

SEQ ID NO: 36741 - RNA, 39 nt, Artificial Sequence
  derived and/or modified sequence opt4 from anti-HIV_CDR
ggcgcccugugguucggccagcugagaggccuggacccc

SEQ ID NO: 36742 - RNA, 39 nt, Artificial Sequence
  derived and/or modified sequence opt4 from anti-HIV_CDR
gaccugagacccaugagaggcaacugggccaugcacgug

SEQ ID NO: 36743 - RNA, 39 nt, Artificial Sequence
  derived and/or modified sequence opt4 from anti-HIV_CDR
gacccccaggugaacagaagaggcaacugcuucgaccac

SEQ ID NO: 36744 - RNA, 39 nt, Artificial Sequence
  derived and/or modified sequence opt4 from anti-HIV_CDR
gacccccagaucgagaucagaggcaacgccuucgacauc

SEQ ID NO: 36745 - RNA, 39 nt, Artificial Sequence
  derived and/or modified sequence opt4 from anti-HIV_CDR
gugcccagaaccaccgccaccagaaacgccuucgacauc

SEQ ID NO: 36746 - RNA, 39 nt, Artificial Sequence
  derived and/or modified sequence opt4 from anti-HIV_CDR
cacaagagcgugcugcugugguucagagagcuggacuac

SEQ ID NO: 36747 - RNA, 39 nt, Artificial Sequence
  derived and/or modified sequence opt4 from anti-HIV_CDR
gacagcgaggacuacguggacuacuacuacauggacgug

SEQ ID NO: 36748 - RNA, 39 nt, Artificial Sequence
  derived and/or modified sequence opt4 from anti-HIV_CDR
cugcccagaaccaccggcaucagaaacgccuucgacauc

SEQ ID NO: 36749 - RNA, 39 nt, Artificial Sequence
  derived and/or modified sequence opt4 from anti-HIV_CDR
cugcccagaaccaccggcaucagaaacgccuucgacuuc

SEQ ID NO: 36750 - RNA, 42 nt, Artificial Sequence
  derived and/or modified sequence opt4 from anti-HIV_CDR
ggcacccugugguucggcgagagcggccugagacuggaccac

SEQ ID NO: 36751 - RNA, 42 nt, Artificial Sequence
  derived and/or modified sequence opt4 from anti-HIV_CDR
guggccuacgugcacguggugaccaccagaagccuggacaac

SEQ ID NO: 36752 - RNA, 42 nt, Artificial Sequence
  derived and/or modified sequence opt4 from anti-HIV_CDR
gccgacuacgaccugcugaccagcagcuaccacuucgacagc

SEQ ID NO: 36753 - RNA, 42 nt, Artificial Sequence
  derived and/or modified sequence opt4 from anti-HIV_CDR
accagaugcuucggcgccaacugcuucaacuucauggacgug

SEQ ID NO: 36754 - RNA, 42 nt, Artificial Sequence
  derived and/or modified sequence opt4 from anti-HIV_CDR
ggcggccuguacugcagcagcaucagcugcaucauggacgug

SEQ ID NO: 36755 - RNA, 42 nt, Artificial Sequence
  derived and/or modified sequence opt4 from anti-HIV_CDR
aacgagccccaguaccacagccugcccggcauguucgacuac

SEQ ID NO: 36756 - RNA, 42 nt, Artificial Sequence
  derived and/or modified sequence opt4 from anti-HIV_CDR
gagcccagagagaugggcacccugaccgccggcuucgaguac

SEQ ID NO: 36757 - RNA, 42 nt, Artificial Sequence
  derived and/or modified sequence opt4 from anti-HIV_CDR
gccaccggcuacagcuacggcuaccuggacgccuucgacauc

SEQ ID NO: 36758 - RNA, 42 nt, Artificial Sequence
  derived and/or modified sequence opt4 from anti-HIV_CDR
ggcagccugugguucggcgagagcggccugagacuggaccac

SEQ ID NO: 36759 - RNA, 42 nt, Artificial Sequence
  derived and/or modified sequence opt4 from anti-HIV_CDR
gacaacaccaucagcggcguggugcccagaugguucgacuac

SEQ ID NO: 36760 - RNA, 42 nt, Artificial Sequence
  derived and/or modified sequence opt4 from anti-HIV_CDR
aucuacgacggcagaggcuacuacagcuacuucuucgaccug

SEQ ID NO: 36761 - RNA, 42 nt, Artificial Sequence
  derived and/or modified sequence opt4 from anti-HIV_CDR
gacagauucaacuggaacgacggcggcuacuucuucgacagc

SEQ ID NO: 36762 - RNA, 42 nt, Artificial Sequence
  derived and/or modified sequence opt4 from anti-HIV_CDR
ggccacagcagcagcuggaccaaguucaacugguucggcccc

SEQ ID NO: 36763 - RNA, 42 nt, Artificial Sequence; identical to SEQ ID NO: 13837
  derived and/or modified sequence opt4 from anti-HIV_CDR

SEQ ID NO: 36764 - RNA, 42 nt, Artificial Sequence
  derived and/or modified sequence opt4 from anti-HIV_CDR
agcuucuacgacaacggcggcuacuaccugggccuggacuac

SEQ ID NO: 36765 - RNA, 42 nt, Artificial Sequence
  derived and/or modified sequence opt4 from anti-HIV_CDR
gacaaggacgccagcaucuacggcuacagaauccugaaccac

SEQ ID NO: 36766 - RNA, 42 nt, Artificial Sequence
  derived and/or modified sequence opt4 from anti-HIV_CDR
gugcugaccgaccuggaccagggcaaccccagaauggacgug

SEQ ID NO: 36767 - RNA, 42 nt, Artificial Sequence
  derived and/or modified sequence opt4 from anti-HIV_CDR
agagagaucaaguucggcgagcugagcuucuacuucgacagc

SEQ ID NO: 36768 - RNA, 42 nt, Artificial Sequence
  derived and/or modified sequence opt4 from anti-HIV_CDR
agagagaucagauucggcgagcugagcuucuacuucgacuac

SEQ ID NO: 36769 - RNA, 42 nt, Artificial Sequence
  derived and/or modified sequence opt4 from anti-HIV_CDR
ccccacagccccaccaacauccccagcagaccccuggacuac

SEQ ID NO: 36770 - RNA, 42 nt, Artificial Sequence
  derived and/or modified sequence opt4 from anti-HIV_CDR
ggcgacuacgacauccugaccagcagcuaccaguucgacuac

SEQ ID NO: 36771 - RNA, 42 nt, Artificial Sequence
  derived and/or modified sequence opt4 from anti-HIV_CDR
agcaccccccugguguggccccccgccaacggccuggacgug

SEQ ID NO: 36772 - RNA, 42 nt, Artificial Sequence
  derived and/or modified sequence opt4 from anti-HIV_CDR
accagaaacaccggcaacagccugcccuacugguucgaccug

SEQ ID NO: 36773 - RNA, 45 nt, Artificial Sequence
  derived and/or modified sequence opt4 from anti-HIV_CDR
gagaagggccaguggcugaccgugccccccuacuacuucgacagc

SEQ ID NO: 36774 - RNA, 45 nt, Artificial Sequence
  derived and/or modified sequence opt4 from anti-HIV_CDR
ggcagcggcagauggaccaucggcgccagaaucuacuucgacaac

SEQ ID NO: 36775 - RNA, 45 nt, Artificial Sequence; identical to SEQ ID NO: 13849
  derived and/or modified sequence opt4 from anti-HIV_CDR

SEQ ID NO: 36776 - RNA, 45 nt, Artificial Sequence
  derived and/or modified sequence opt4 from anti-HIV_CDR
cuggaggccgacggcggcgacuacagccccaagauguucgacuac

SEQ ID NO: 36777 - RNA, 45 nt, Artificial Sequence; identical to SEQ ID NO: 13851
  derived and/or modified sequence opt4 from anti-HIV_CDR

SEQ ID NO: 36778 - RNA, 45 nt, Artificial Sequence; identical to SEQ ID NO: 13852
  derived and/or modified sequence opt4 from anti-HIV_CDR

SEQ ID NO: 36779 - RNA, 45 nt, Artificial Sequence
  derived and/or modified sequence opt4 from anti-HIV_CDR
cuggaggccgacggcagcgacuacagccccaagauguucgacuuc

SEQ ID NO: 36780 - RNA, 45 nt, Artificial Sequence; identical to SEQ ID NO: 13854
  derived and/or modified sequence opt4 from anti-HIV_CDR

SEQ ID NO: 36781 - RNA, 45 nt, Artificial Sequence; identical to SEQ ID NO: 13855
  derived and/or modified sequence opt4 from anti-HIV_CDR

SEQ ID NO: 36782 - RNA, 45 nt, Artificial Sequence
  derived and/or modified sequence opt4 from anti-HIV_CDR
gcccccagacuggaccugggcgagcugagcagcggcuuccacuuc

SEQ ID NO: 36783 - RNA, 45 nt, Artificial Sequence
  derived and/or modified sequence opt4 from anti-HIV_CDR
gcccccagacuggagcugggcgagcugagcagcggcuuccacuac

SEQ ID NO: 36784 - RNA, 45 nt, Artificial Sequence
  derived and/or modified sequence opt4 from anti-HIV_CDR
ggcagacugcugaugcaguggccccccagaggcggcuucgacccc

SEQ ID NO: 36785 - RNA, 45 nt, Artificial Sequence
  derived and/or modified sequence opt4 from anti-HIV_CDR
ggcagacuguucaugcaguggccccccagaggcggcuucgacccc

SEQ ID NO: 36786 - RNA, 45 nt, Artificial Sequence
  derived and/or modified sequence opt4 from anti-HIV_CDR
ggcagacuguucgugcaguggcccccccagggcggcuucgacccc

SEQ ID NO: 36787 - RNA, 45 nt, Artificial Sequence
  derived and/or modified sequence opt4 from anti-HIV_CDR
ggcagacuguucaugcaguggcccccccagggcggcuucgacccc

SEQ ID NO: 36788 - RNA, 45 nt, Artificial Sequence
  derived and/or modified sequence opt4 from anti-HIV_CDR
ggcagacuguucgugcaguggcccccccagggcggcuucgacacc

SEQ ID NO: 36789 - RNA, 45 nt, Artificial Sequence
  derived and/or modified sequence opt4 from anti-HIV_CDR
aacaacaacaccagaaagagcaucaacaucggccccggcagagcc

SEQ ID NO: 36790 - RNA, 45 nt, Artificial Sequence; identical to SEQ ID NO: 13864
  derived and/or modified sequence opt4 from anti-HIV_CDR

SEQ ID NO: 36791 - RNA, 45 nt, Artificial Sequence
  derived and/or modified sequence opt4 from anti-HIV_CDR
gaccugcugcccgacuaccccgugagcagcgcccccgaggacuuc

SEQ ID NO: 36792 - RNA, 45 nt, Artificial Sequence
  derived and/or modified sequence opt4 from anti-HIV_CDR
gagagcuggcuguacagcaacggcgacuacuacuacauggacgug

SEQ ID NO: 36793 - RNA, 45 nt, Artificial Sequence
  derived and/or modified sequence opt4 from anti-HIV_CDR
agauacugcagcagcaccaccugcuacagaggccacuucgacuac

SEQ ID NO: 36794 - RNA, 45 nt, Artificial Sequence
  derived and/or modified sequence opt4 from anti-HIV_CDR
cagaccaccgacgagggcagacaguggcuggugggcuuccagcac

SEQ ID NO: 36795 - RNA, 45 nt, Artificial Sequence
  derived and/or modified sequence opt4 from anti-HIV_CDR
cccagcuacggcggcuacgacgaccagggcugguacuucgaguac

SEQ ID NO: 36796 - RNA, 45 nt, Artificial Sequence
  derived and/or modified sequence opt4 from anti-HIV_CDR
gccgccauccccaucggcgacagcaaguacagcuacuucgacagc

SEQ ID NO: 36797 - RNA, 45 nt, Artificial Sequence
  derived and/or modified sequence opt4 from anti-HIV_CDR
gcccccccccccggcagcaccgagugggccuacuacuucgacuac

SEQ ID NO: 36798 - RNA, 45 nt, Artificial Sequence
  derived and/or modified sequence opt4 from anti-HIV_CDR
gcccaguuccacaacagcggcuacuacuacagcggccuggacuac

SEQ ID NO: 36799 - RNA, 45 nt, Artificial Sequence
  derived and/or modified sequence opt4 from anti-HIV_CDR
ggcggcuacgacuacggcgaccacuacuacuacuacauggacgug

SEQ ID NO: 36800 - RNA, 45 nt, Artificial Sequence
  derived and/or modified sequence opt4 from anti-HIV_CDR
ggcacccagagcuacagcgccguggcccccggcugguucgacccc

SEQ ID NO: 36801 - RNA, 45 nt, Artificial Sequence
  derived and/or modified sequence opt4 from anti-HIV_CDR
aucaagggcccccccagaggcaacuucggcguggccuucuacuuc

SEQ ID NO: 36802 - RNA, 45 nt, Artificial Sequence
  derived and/or modified sequence opt4 from anti-HIV_CDR
aagguguacagcgacggcuggagcccccccaccggcuucguguac

SEQ ID NO: 36803 - RNA, 45 nt, Artificial Sequence
  derived and/or modified sequence opt4 from anti-HIV_CDR
agauacaaguaccugcccggcgaccagcacaugcccugggacaac

SEQ ID NO: 36804 - RNA, 45 nt, Artificial Sequence
  derived and/or modified sequence opt4 from anti-HIV_CDR
agauacaaguaccugcccggcgaccagcacaugcccugggacuac

SEQ ID NO: 36805 - RNA, 45 nt, Artificial Sequence
  derived and/or modified sequence opt4 from anti-HIV_CDR
ggcggcggcuacgccguggugggccccaaguacggccuggacgug

SEQ ID NO: 36806 - RNA, 45 nt, Artificial Sequence
  derived and/or modified sequence opt4 from anti-HIV_CDR
cuggacagcagcagcggcugggaggaggugggcuacuucgacaga

SEQ ID NO: 36807 - RNA, 45 nt, Artificial Sequence
  derived and/or modified sequence opt4 from anti-HIV_CDR
gagaacuacagcgacggcugggaggaggugggccacuucgacuac

SEQ ID NO: 36808 - RNA, 45 nt, Artificial Sequence
  derived and/or modified sequence opt4 from anti-HIV_CDR
gagaacuacagcgacggcugggaggaggugggccacuucgacagc

SEQ ID NO: 36809 - RNA, 45 nt, Artificial Sequence
  derived and/or modified sequence opt4 from anti-HIV_CDR
gagaacuacagcgacggcuggaacgaggugggccacuucgacuuc

SEQ ID NO: 36810 - RNA, 45 nt, Artificial Sequence
  derived and/or modified sequence opt4 from anti-HIV_CDR
gagaacuacagcgacggcugguacgaggugggccacuucgaccug

SEQ ID NO: 36811 - RNA, 45 nt, Artificial Sequence
  derived and/or modified sequence opt4 from anti-HIV_CDR
gacagaagaagauuccuggaguggagccuguacggcauggacgug

SEQ ID NO: 36812 - RNA, 45 nt, Artificial Sequence
  derived and/or modified sequence opt4 from anti-HIV_CDR
ggccccagaguguucuucgagagcagcggcuacuacuucagagac

SEQ ID NO: 36813 - RNA, 45 nt, Artificial Sequence
  derived and/or modified sequence opt4 from anti-HIV_CDR
ggccccagagugcuguucgagagcagcggccacuaccugagagac

SEQ ID NO: 36814 - RNA, 45 nt, Artificial Sequence
  derived and/or modified sequence opt4 from anti-HIV_CDR
ggccccagaguguucuucgagagcagcggcuacuacuucagaaac

SEQ ID NO: 36815 - RNA, 45 nt, Artificial Sequence
  derived and/or modified sequence opt4 from anti-HIV_CDR
gagggcggcagccugugguucggcggcgccaacuggcuggacccc

SEQ ID NO: 36816 - RNA, 45 nt, Artificial Sequence
  derived and/or modified sequence opt4 from anti-HIV_CDR
gccgacuacgacaacaucugggacagcagaggcggcuucgaccug

SEQ ID NO: 36817 - RNA, 45 nt, Artificial Sequence
  derived and/or modified sequence opt4 from anti-HIV_CDR
gugggcggcaccguguggagcggcuacagcaacuaccuggacuac

SEQ ID NO: 36818 - RNA, 45 nt, Artificial Sequence
  derived and/or modified sequence opt4 from anti-HIV_CDR
gacaacagagaccaguggcuggugcugagaagcugguucgacccc

SEQ ID NO: 36819 - RNA, 45 nt, Artificial Sequence
  derived and/or modified sequence opt4 from anti-HIV_CDR
gagaagggccagugggugacccugccccccuacuacuucgacagc

SEQ ID NO: 36820 - RNA, 48 nt, Artificial Sequence
  derived and/or modified sequence opt4 from anti-HIV_CDR
uacuucagcgacaccgacagaagcgaguacagccccagccugagaagc

SEQ ID NO: 36821 - RNA, 48 nt, Artificial Sequence
  derived and/or modified sequence opt4 from anti-HIV_CDR
uacaucagcgacagagagagcgccaccuacaaccccagccugaacagc

SEQ ID NO: 36822 - RNA, 48 nt, Artificial Sequence
  derived and/or modified sequence opt4 from anti-HIV_CDR
uacuucagcgacaccgagaagagcaacuacaaccccagccugagaagc

SEQ ID NO: 36823 - RNA, 48 nt, Artificial Sequence
  derived and/or modified sequence opt4 from anti-HIV_CDR
uacaucagcgacagagccagcgccaccuacaaccccagccugaacagc

SEQ ID NO: 36824 - RNA, 48 nt, Artificial Sequence
  derived and/or modified sequence opt4 from anti-HIV_CDR
uacgugcaccacagcggcgacaccaacuacaaccccagccugaagaga

SEQ ID NO: 36825 - RNA, 48 nt, Artificial Sequence
  derived and/or modified sequence opt4 from anti-HIV_CDR
uacgugcacaagagcggcgacaccaacuacagccccagccugaagagc

SEQ ID NO: 36826 - RNA, 48 nt, Artificial Sequence
  derived and/or modified sequence opt4 from anti-HIV_CDR
uacgugcacgacagcggcgacaccaacuacaaccccagccugaagagc

SEQ ID NO: 36827 - RNA, 48 nt, Artificial Sequence
  derived and/or modified sequence opt4 from anti-HIV_CDR
uacaucagcaagagcgagagcgccaacuacaaccccagccugaacagc

SEQ ID NO: 36828 - RNA, 48 nt, Artificial Sequence
  derived and/or modified sequence opt4 from anti-HIV_CDR
uacaucuacuacagcggcagcaccaacuacaaccccagccugaagagc

SEQ ID NO: 36829 - RNA, 48 nt, Artificial Sequence
  derived and/or modified sequence opt4 from anti-HIV_CDR
uacgugcacgacagcggcgacaucaacuacaaccccagccugaagaac

SEQ ID NO: 36830 - RNA, 48 nt, Artificial Sequence
  derived and/or modified sequence opt4 from anti-HIV_CDR
agcuacuacgacuucagcaucggcgacggcaacgacgccuucgacgug

SEQ ID NO: 36831 - RNA, 48 nt, Artificial Sequence
  derived and/or modified sequence opt4 from anti-HIV_CDR
ggcuucagaggcagccccuucagcagcggcagccuguacuucgacagc

SEQ ID NO: 36832 - RNA, 48 nt, Artificial Sequence
  derived and/or modified sequence opt4 from anti-HIV_CDR
gugaucagcggcagaaucaccaucuucuacuacaacuacaucgacgug

SEQ ID NO: 36833 - RNA, 48 nt, Artificial Sequence
  derived and/or modified sequence opt4 from anti-HIV_CDR
gacggccugggcgagguggcccccgacuacagauacggcaucgacgug

SEQ ID NO: 36834 - RNA, 48 nt, Artificial Sequence
  derived and/or modified sequence opt4 from anti-HIV_CDR
gacggccugggcgagcuggcccccgccuaccaguacggcaucgacgug

SEQ ID NO: 36835 - RNA, 48 nt, Artificial Sequence
  derived and/or modified sequence opt4 from anti-HIV_CDR
gacggccugggcgagcuggcccccgccuaccacuacggcaucgacgug

SEQ ID NO: 36836 - RNA, 48 nt, Artificial Sequence
  derived and/or modified sequence opt4 from anti-HIV_CDR
gacggccugggcgagguggcccccgccuaccuguacggcaucgacgcc

SEQ ID NO: 36837 - RNA, 48 nt, Artificial Sequence
  derived and/or modified sequence opt4 from anti-HIV_CDR
gccgugaagggcuucugguucgacgagguguacaacugguucggcccc

SEQ ID NO: 36838 - RNA, 48 nt, Artificial Sequence
  derived and/or modified sequence opt4 from anti-HIV_CDR
gccgugaagggcuucugguucgacgaccccuacaccugguucggcccc

SEQ ID NO: 36839 - RNA, 48 nt, Artificial Sequence
  derived and/or modified sequence opt4 from anti-HIV_CDR
gccgugaagggcuucugguucgacgagcccagcaccugguucggcccc

SEQ ID NO: 36840 - RNA, 48 nt, Artificial Sequence
  derived and/or modified sequence opt4 from anti-HIV_CDR
gccgugaagggccugugguucgacgagaccuacaccugguucggcccc

SEQ ID NO: 36841 - RNA, 48 nt, Artificial Sequence
  derived and/or modified sequence opt4 from anti-HIV_CDR
gccguggccggccugugguucgaggacgccuacaacugguucggcccc

SEQ ID NO: 36842 - RNA, 48 nt, Artificial Sequence
  derived and/or modified sequence opt4 from anti-HIV_CDR
gccgaggccgagagccagagccacagcagacccaucauguucgacuac

SEQ ID NO: 36843 - RNA, 48 nt, Artificial Sequence
  derived and/or modified sequence opt4 from anti-HIV_CDR
gccgaggccgccagcgacagccacagcagacccaucauguucgaccac

SEQ ID NO: 36844 - RNA, 48 nt, Artificial Sequence
  derived and/or modified sequence opt4 from anti-HIV_CDR
cuggaggccgagagcgacagccacagcagacccaucauguucgaccac

SEQ ID NO: 36845 - RNA, 48 nt, Artificial Sequence
  derived and/or modified sequence opt4 from anti-HIV_CDR
gccgaggccgagagccagagccacagcagacccaucauguucgacagc

SEQ ID NO: 36846 - RNA, 48 nt, Artificial Sequence
  derived and/or modified sequence opt4 from anti-HIV_CDR
gccgaggccgagagccagagccacagcagacccaucauguucgacuuc

SEQ ID NO: 36847 - RNA, 48 nt, Artificial Sequence
  derived and/or modified sequence opt4 from anti-HIV_CDR
gacaacccccugcugcagagcggcgaguucagcagcagccuggagaac

SEQ ID NO: 36848 - RNA, 48 nt, Artificial Sequence
  derived and/or modified sequence opt4 from anti-HIV_CDR
gacaacccccugcugcagagcggcgaguucagcagcagccuggacaac

SEQ ID NO: 36849 - RNA, 48 nt, Artificial Sequence
  derived and/or modified sequence opt4 from anti-HIV_CDR
ggcagagacuacaacuucuggggcggcggcggcaagaucaacuucccc

SEQ ID NO: 36850 - RNA, 48 nt, Artificial Sequence
  derived and/or modified sequence opt4 from anti-HIV_CDR
accaacugggccaacgacuucgugaccggcuacuacagauucgacuuc

SEQ ID NO: 36851 - RNA, 48 nt, Artificial Sequence
  derived and/or modified sequence opt4 from anti-HIV_CDR
gccggccacugcagcagcaccagcagcguguacugccccuucgacaug

SEQ ID NO: 36852 - RNA, 48 nt, Artificial Sequence
  derived and/or modified sequence opt4 from anti-HIV_CDR
caggugagcagcuacagcagcagcggcuacagaagagaguucgacuac

SEQ ID NO: 36853 - RNA, 48 nt, Artificial Sequence
  derived and/or modified sequence opt4 from anti-HIV_CDR
agaauggccacccugaccggcggcuacuacuacuacuacauggacgug

SEQ ID NO: 36854 - RNA, 48 nt, Artificial Sequence
  derived and/or modified sequence opt4 from anti-HIV_CDR
gagggcggcuacagcgacuucuggagcggcuacagcggcuucgacuac

SEQ ID NO: 36855 - RNA, 48 nt, Artificial Sequence
  derived and/or modified sequence opt4 from anti-HIV_CDR
cuguacuacaacuucggcagcggcuacgacaccggcaucggcgaccac

SEQ ID NO: 36856 - RNA, 48 nt, Artificial Sequence
  derived and/or modified sequence opt4 from anti-HIV_CDR
gccagagagggcagaugguucagcgacaacuacuacgccauggacgug

SEQ ID NO: 36857 - RNA, 48 nt, Artificial Sequence
  derived and/or modified sequence opt4 from anti-HIV_CDR
gacagagugggcagaagacugggcgagcugagcgccggcuucgacuac

SEQ ID NO: 36858 - RNA, 48 nt, Artificial Sequence
  derived and/or modified sequence opt4 from anti-HIV_CDR
gccagacccagaagccccugggacagcaccggcuggagcgugggcuac

SEQ ID NO: 36859 - RNA, 48 nt, Artificial Sequence
  derived and/or modified sequence opt4 from anti-HIV_CDR
agcuacuacgacuucagaagcgacagcggcaacgacgccuucgacauc

SEQ ID NO: 36860 - RNA, 48 nt, Artificial Sequence
  derived and/or modified sequence opt4 from anti-HIV_CDR
agcuacuacgacuuccagaccgacagcggcaacgacgccuucgacgug

SEQ ID NO: 36861 - RNA, 48 nt, Artificial Sequence
  derived and/or modified sequence opt4 from anti-HIV_CDR
gacaaccccgugcugcagcugggcgagcugagcagcagccuggacuac

SEQ ID NO: 36862 - RNA, 48 nt, Artificial Sequence
  derived and/or modified sequence opt4 from anti-HIV_CDR
ggcuucagaggcagccccuucagcagcggcagcauguacuucgacagc

SEQ ID NO: 36863 - RNA, 48 nt, Artificial Sequence
  derived and/or modified sequence opt4 from anti-HIV_CDR
ggcuucagaggcagcccccugagcagcggcagccuguacuucgacagc

SEQ ID NO: 36864 - RNA, 48 nt, Artificial Sequence
  derived and/or modified sequence opt4 from anti-HIV_CDR
ggcuucagaggcaacguguucagcaccggcugguucuaccuggacuuc

SEQ ID NO: 36865 - RNA, 48 nt, Artificial Sequence
  derived and/or modified sequence opt4 from anti-HIV_CDR
gacagacugagcuucagcgugcagguggagcagggcgugcuggacuac

SEQ ID NO: 36866 - RNA, 48 nt, Artificial Sequence
  derived and/or modified sequence opt4 from anti-HIV_CDR
gacagacugagcuucagcgugcagguggagcagggcgugcugcaguuc

SEQ ID NO: 36867 - RNA, 48 nt, Artificial Sequence
  derived and/or modified sequence opt4 from anti-HIV_CDR
gugcugagcggcagaaucaccaucuucuacuacuacuacauggacgug

SEQ ID NO: 36868 - RNA, 51 nt, Artificial Sequence
  derived and/or modified sequence opt4 from anti-HIV_CDR
uacaucagcagcggcagcagcacccugcacuacgccgacaccgugaagggc

SEQ ID NO: 36869 - RNA, 51 nt, Artificial Sequence
  derived and/or modified sequence opt4 from anti-HIV_CDR
agauaccuggacuggagccccaucggcagagacaccuacggcaccgacgug

SEQ ID NO: 36870 - RNA, 51 nt, Artificial Sequence
  derived and/or modified sequence opt4 from anti-HIV_CDR
agauacuucgacuggagccccuucagaagagacaccuacggcaccgacgug

SEQ ID NO: 36871 - RNA, 51 nt, Artificial Sequence
  derived and/or modified sequence opt4 from anti-HIV_CDR
ggcagagacuacaacuucuggagcggcggcggcagauacuacuucgacuuc

SEQ ID NO: 36872 - RNA, 51 nt, Artificial Sequence
  derived and/or modified sequence opt4 from anti-HIV_CDR
ggcauccaggaggacuacgacuucuggagagaguacagagagcuggacuac

SEQ ID NO: 36873 - RNA, 51 nt, Artificial Sequence
  derived and/or modified sequence opt4 from anti-HIV_CDR
gugcugaacaacaacaccagaaagagcaucaacaucggccccggcagagcc

SEQ ID NO: 36874 - RNA, 51 nt, Artificial Sequence
  derived and/or modified sequence opt4 from anti-HIV_CDR
gaccugaacuucggcguggugacccccuacuacuacuacuaccuggacgug

SEQ ID NO: 36875 - RNA, 51 nt, Artificial Sequence
  derived and/or modified sequence opt4 from anti-HIV_CDR
cacggcagaaccguguucggcguggugagaaacuacuacuacauggacgug

SEQ ID NO: 36876 - RNA, 51 nt, Artificial Sequence
  derived and/or modified sequence opt4 from anti-HIV_CDR
cacuacuacggcagcggccugaccaaggacuacuacgaguacaucgacgug

SEQ ID NO: 36877 - RNA, 51 nt, Artificial Sequence
  derived and/or modified sequence opt4 from anti-HIV_CDR
accuacuacaacuucuggagcgaccagagccagggccuggacuucgacuac

SEQ ID NO: 36878 - RNA, 51 nt, Artificial Sequence
  derived and/or modified sequence opt4 from anti-HIV_CDR
ggcgugugggaggcccccgacggcagcagcuacuacuacuacauggccgac

SEQ ID NO: 36879 - RNA, 51 nt, Artificial Sequence
  derived and/or modified sequence opt4 from anti-HIV_CDR
gaccagggcggcuaccccgugagccccgugggccccaagugguucgacccc

SEQ ID NO: 36880 - RNA, 51 nt, Artificial Sequence
  derived and/or modified sequence opt4 from anti-HIV_CDR
agagacaaguaccaguacaucgacagcagcggcgacuaccccuucgacaga

SEQ ID NO: 36881 - RNA, 51 nt, Artificial Sequence
  derived and/or modified sequence opt4 from anti-HIV_CDR
cagcugagagcccccaccaccagauucagacacggcggcuacuucgagaac

SEQ ID NO: 36882 - RNA, 51 nt, Artificial Sequence
  derived and/or modified sequence opt4 from anti-HIV_CDR
caggugagagcccccacccugagauucagacacggcggcuacuucgagacc

SEQ ID NO: 36883 - RNA, 51 nt, Artificial Sequence
  derived and/or modified sequence opt4 from anti-HIV_CDR
gugagcaucaccuacgccggccugaucguggugcccggcgccuucgacgug

SEQ ID NO: 36884 - RNA, 51 nt, Artificial Sequence
  derived and/or modified sequence opt4 from anti-HIV_CDR
guggccaucagcuacgccggccugaucguggugcccggccccuucgacgug

SEQ ID NO: 36885 - RNA, 51 nt, Artificial Sequence
  derived and/or modified sequence opt4 from anti-HIV_CDR
agccugaccggcagacugcaccugggcgagcugagcagcggcaucggcccc

SEQ ID NO: 36886 - RNA, 51 nt, Artificial Sequence
  derived and/or modified sequence opt4 from anti-HIV_CDR
ggcggcagcgcccugaucaccaucuucggcguggaccccaaguucgacccc

SEQ ID NO: 36887 - RNA, 51 nt, Artificial Sequence
  derived and/or modified sequence opt4 from anti-HIV_CDR
auggcccugaccagcggccccuacgacgugagcggcuacuacuucgacuac

SEQ ID NO: 36888 - RNA, 51 nt, Artificial Sequence
  derived and/or modified sequence opt4 from anti-HIV_CDR
auggcccuggccagcggccccuacgacgugagcggcuacuacuucgacuac

SEQ ID NO: 36889 - RNA, 51 nt, Artificial Sequence
  derived and/or modified sequence opt4 from anti-HIV_CDR
auggcccugcccagcggcccccuggacagaagcggcuacuacuucgacgac

SEQ ID NO: 36890 - RNA, 54 nt, Artificial Sequence
  derived and/or modified sequence opt4 from anti-HIV_CDR
guggugcccauguucagcaucuucggcguggugaaggccaacuacuucgacuac

SEQ ID NO: 36891 - RNA, 54 nt, Artificial Sequence
  derived and/or modified sequence opt4 from anti-HIV_CDR
aacagaagaguggccaugcccgaggccaugauccugagcuucuacauggacgug

SEQ ID NO: 36892 - RNA, 54 nt, Artificial Sequence
  derived and/or modified sequence opt4 from anti-HIV_CDR
ggccugugcagaggcggcaacugcagacugggccccagcggcuggcuggacccc

SEQ ID NO: 36893 - RNA, 54 nt, Artificial Sequence
  derived and/or modified sequence opt4 from anti-HIV_CDR
acccccccccacuacgacgugcugaccggcuaccccagcagcgugcuggaguuc

SEQ ID NO: 36894 - RNA, 54 nt, Artificial Sequence
  derived and/or modified sequence opt4 from anti-HIV_CDR
auccccuaccacagcgagagcuacuacaagguggugaucggcggcuucgacgug

SEQ ID NO: 36895 - RNA, 54 nt, Artificial Sequence
  derived and/or modified sequence opt4 from anti-HIV_CDR
gccgaccccuucaagguggcccaggacgagggccuguucgugaucuucgacuac

SEQ ID NO: 36896 - RNA, 54 nt, Artificial Sequence
  derived and/or modified sequence opt4 from anti-HIV_CDR
gccgaccccuucaagguggcccaggacgagggccuguacgugaucuucgacuac

SEQ ID NO: 36897 - RNA, 54 nt, Artificial Sequence
  derived and/or modified sequence opt4 from anti-HIV_CDR
gccgacagauucaagguggcccaggacgagggccuguucgugaucuucgacuac

SEQ ID NO: 36898 - RNA, 54 nt, Artificial Sequence
  derived and/or modified sequence opt4 from anti-HIV_CDR
ggcagacagaccuucagagccaucuggagcggcccccccgccguguucgacauc

SEQ ID NO: 36899 - RNA, 54 nt, Artificial Sequence
  derived and/or modified sequence opt4 from anti-HIV_CDR
ggcagacagaccuucagagccaucuggagcggcccccccgugguguucgacauc

SEQ ID NO: 36900 - RNA, 54 nt, Artificial Sequence
  derived and/or modified sequence opt4 from anti-HIV_CDR
agcagaggcgacuacaacuucuggagcggcuaccccgaguaccacuucgacaga

SEQ ID NO: 36901 - RNA, 54 nt, Artificial Sequence
  derived and/or modified sequence opt4 from anti-HIV_CDR
cugcccaagagcagaauggugggcggcgaccaccugcccuucuaccccgacuuc

SEQ ID NO: 36902 - RNA, 54 nt, Artificial Sequence
  derived and/or modified sequence opt4 from anti-HIV_CDR
cugaccggccccagcggcuacugcgacagcagcggcugcuacugguucgacccc

SEQ ID NO: 36903 - RNA, 54 nt, Artificial Sequence
  derived and/or modified sequence opt4 from anti-HIV_CDR
ggcggcagcaugaucagaggcgugcccagccccuucuacuacggcauggacgug

SEQ ID NO: 36904 - RNA, 54 nt, Artificial Sequence
  derived and/or modified sequence opt4 from anti-HIV_CDR
cuguucggcgccaagagacugggcguggcccccagcggcuacuacauggacgug

SEQ ID NO: 36905 - RNA, 54 nt, Artificial Sequence
  derived and/or modified sequence opt4 from anti-HIV_CDR
gacagauacgaggccgccugguucggcgccgacaagguguacggcauggacgug

SEQ ID NO: 36906 - RNA, 54 nt, Artificial Sequence
  derived and/or modified sequence opt4 from anti-HIV_CDR
gagcacagacugcccccccccaccggcagaagaaccagaaacugguucgacccc

SEQ ID NO: 36907 - RNA, 54 nt, Artificial Sequence
  derived and/or modified sequence opt4 from anti-HIV_CDR
ggcagaggcagcuuccagggcuuccagcaguacgaguacuacggcauggacgug

SEQ ID NO: 36908 - RNA, 54 nt, Artificial Sequence
  derived and/or modified sequence opt4 from anti-HIV_CDR
ggcagaggcuacagccacggcuuccagcaguacaacuacuacggcauggacgug

SEQ ID NO: 36909 - RNA, 54 nt, Artificial Sequence
  derived and/or modified sequence opt4 from anti-HIV_CDR
ggcagaggcagcuucaccggcuucgaccaguaccacuacuacggcauggacgug

SEQ ID NO: 36910 - RNA, 54 nt, Artificial Sequence
  derived and/or modified sequence opt4 from anti-HIV_CDR
ggcagaggcagcaccuuccccagcgcccaguucagcuacuucggccuggacgug

SEQ ID NO: 36911 - RNA, 54 nt, Artificial Sequence
  derived and/or modified sequence opt4 from anti-HIV_CDR
gaccuggccagauacggcgugaccagcaucgugcccgaguucggcuucgacuuc

SEQ ID NO: 36912 - RNA, 54 nt, Artificial Sequence
  derived and/or modified sequence opt4 from anti-HIV_CDR
agaggcagacugaacauccccagccccagcgccauccugaccgccuucgacgug

SEQ ID NO: 36913 - RNA, 54 nt, Artificial Sequence
  derived and/or modified sequence opt4 from anti-HIV_CDR
ggccccggcagcauggugagaggccugaucgugaccagcuacggcauggacgug

SEQ ID NO: 36914 - RNA, 54 nt, Artificial Sequence
  derived and/or modified sequence opt4 from anti-HIV_CDR
aagagagugaccaucuucggcgugguggacacccccagaggcuacuucgacuac

SEQ ID NO: 36915 - RNA, 54 nt, Artificial Sequence
  derived and/or modified sequence opt4 from anti-HIV_CDR
ggccagagaaacgugcugcacuuccuggagagaaagaacgacgccuucgacauc

SEQ ID NO: 36916 - RNA, 54 nt, Artificial Sequence
  derived and/or modified sequence opt4 from anti-HIV_CDR
gagcagaaggacuacgacuucuggaacggccuguacaaguacggcauggacgug

SEQ ID NO: 36917 - RNA, 57 nt, Artificial Sequence; identical to SEQ ID NO: 21633
  derived and/or modified sequence opt4 from anti-HIV_CDR

SEQ ID NO: 36918 - RNA, 57 nt, Artificial Sequence
  derived and/or modified sequence opt4 from anti-HIV_CDR
gccggccuggacuacaacuucuggaacggcaagggcagaaagggcgccuucgacgug

SEQ ID NO: 36919 - RNA, 57 nt, Artificial Sequence
  derived and/or modified sequence opt4 from anti-HIV_CDR
aacgaggccgacuaccacgacggcaacggccacagccugagaggcauguucgacuac

SEQ ID NO: 36920 - RNA, 57 nt, Artificial Sequence
  derived and/or modified sequence opt4 from anti-HIV_CDR
aacgagccccaguaccacgacggcaacggccacagccugcccggcauguucgacagc

SEQ ID NO: 36921 - RNA, 57 nt, Artificial Sequence
  derived and/or modified sequence opt4 from anti-HIV_CDR
aacgagccccaguaccacgacgacaacggccacagccugcccggcaugaucgacuac

SEQ ID NO: 36922 - RNA, 57 nt, Artificial Sequence
  derived and/or modified sequence opt4 from anti-HIV_CDR
aacgagccccaguaccacgacggcaacggccacagccugcccggcauguucgacuuc

SEQ ID NO: 36923 - RNA, 57 nt, Artificial Sequence
  derived and/or modified sequence opt4 from anti-HIV_CDR
aacgagccccaguacuucgacggcagcggccacagccugcccggcauguucgacuac

SEQ ID NO: 36924 - RNA, 57 nt, Artificial Sequence
  derived and/or modified sequence opt4 from anti-HIV_CDR
agagaggccgacuaccacgacggcaacggccacacccugcccggcauguucgacuuc

SEQ ID NO: 36925 - RNA, 57 nt, Artificial Sequence
  derived and/or modified sequence opt4 from anti-HIV_CDR
aacgagccccaguacuacgacggcagcggccacagccugcccggcauguucgacuac

SEQ ID NO: 36926 - RNA, 57 nt, Artificial Sequence
  derived and/or modified sequence opt4 from anti-HIV_CDR
aacgagccccaguaccacgacggcaacggccacagccugcccggcauguucgacuac

SEQ ID NO: 36927 - RNA, 57 nt, Artificial Sequence
  derived and/or modified sequence opt4 from anti-HIV_CDR
caggacagcgacuuccacgacggccacggccacacccugagaggcauguucgacagc

SEQ ID NO: 36928 - RNA, 57 nt, Artificial Sequence
  derived and/or modified sequence opt4 from anti-HIV_CDR
cuggacugggugagaggcgugaugaaccugguggagaaccacuacgccauggacgug

SEQ ID NO: 36929 - RNA, 57 nt, Artificial Sequence
  derived and/or modified sequence opt4 from anti-HIV_CDR
accaacggcaccgagaucuucagacccggcggcggcgacaugagagacaacuggaga

SEQ ID NO: 36930 - RNA, 57 nt, Artificial Sequence
  derived and/or modified sequence opt4 from anti-HIV_CDR
gacggcagauacagcggcgacgaccaguacuacuaccacuacuacuacauggacgug

SEQ ID NO: 36931 - RNA, 57 nt, Artificial Sequence
  derived and/or modified sequence opt4 from anti-HIV_CDR
cugaccaagaaccccagccaggacuucuggggcagcuaccuguacuacuucgaggac

SEQ ID NO: 36932 - RNA, 57 nt, Artificial Sequence
  derived and/or modified sequence opt4 from anti-HIV_CDR
ggcgccaccuacuacuacgacagcagcggccaccagagcagaagagccuucgacauc

SEQ ID NO: 36933 - RNA, 57 nt, Artificial Sequence
  derived and/or modified sequence opt4 from anti-HIV_CDR
gccuuccaggccagcauggugagaggcgugaucguggaccccuacggcauggacgug

SEQ ID NO: 36934 - RNA, 57 nt, Artificial Sequence
  derived and/or modified sequence opt4 from anti-HIV_CDR
cacagagccgacuacgacuucuggaacggcagcaaccugagaggcuacuucgacccc

SEQ ID NO: 36935 - RNA, 57 nt, Artificial Sequence
  derived and/or modified sequence opt4 from anti-HIV_CDR
cacagagccaacuacgacuucuggggcggcagcaaccugagaggcuacuucgacccc

SEQ ID NO: 36936 - RNA, 57 nt, Artificial Sequence
  derived and/or modified sequence opt4 from anti-HIV_CDR
ggcuuccacuucuggagcggcaccggcaccagacccagaaacugguacuucgaccug

SEQ ID NO: 36937 - RNA, 57 nt, Artificial Sequence
  derived and/or modified sequence opt4 from anti-HIV_CDR
aacuaccugaucgagagcagauacgacgagaaggacuacuacuacgccauggacgug

SEQ ID NO: 36938 - RNA, 57 nt, Artificial Sequence
  derived and/or modified sequence opt4 from anti-HIV_CDR
agcagaggcuacgccuacgacagcggcggccacuacuuccccaccugguucgacccc

SEQ ID NO: 36939 - RNA, 57 nt, Artificial Sequence
  derived and/or modified sequence opt4 from anti-HIV_CDR
gacaccaccaccuucggcgccuucggcggcagccccaacaugggcggccuggacccc

SEQ ID NO: 36940 - RNA, 57 nt, Artificial Sequence
  derived and/or modified sequence opt4 from anti-HIV_CDR
caccuggugguggccguggccgccggccccgacuacuucagcuacggcauggacgug

SEQ ID NO: 36941 - RNA, 57 nt, Artificial Sequence
  derived and/or modified sequence opt4 from anti-HIV_CDR
gacaccaccaccuucagcagcuucggcagcccccccaacaugggcggccuggacccc

SEQ ID NO: 36942 - RNA, 57 nt, Artificial Sequence
  derived and/or modified sequence opt4 from anti-HIV_CDR
gacaccaccaccuucggcgccuucggcggcggcgccaacaugggcggccuggacccc

SEQ ID NO: 36943 - RNA, 57 nt, Artificial Sequence
  derived and/or modified sequence opt4 from anti-HIV_CDR
gacaccaccaccuucaccagcuucggcagcccccccagaaugggcggccuggacccc

SEQ ID NO: 36944 - RNA, 57 nt, Artificial Sequence
  derived and/or modified sequence opt4 from anti-HIV_CDR
gacaccaccaccuucagcagcuucggcagccccccccacaugggcggccuggacccc

SEQ ID NO: 36945 - RNA, 57 nt, Artificial Sequence
  derived and/or modified sequence opt4 from anti-HIV_CDR
gacagagugagcgacuacgacuucuggagcggcaagagaggcuacggcauggacgug

SEQ ID NO: 36946 - RNA, 57 nt, Artificial Sequence
  derived and/or modified sequence opt4 from anti-HIV_CDR
gagcugagcggcgaguaccacuucuggagcggcaccuacagauacggcguggacgug

SEQ ID NO: 36947 - RNA, 57 nt, Artificial Sequence
  derived and/or modified sequence opt4 from anti-HIV_CDR
cacggcgccagcgagaacuacggccccggcagcuacagcgccgagcacuuccagcac

SEQ ID NO: 36948 - RNA, 57 nt, Artificial Sequence
  derived and/or modified sequence opt4 from anti-HIV_CDR
cacggcgccagcgccaacuacggccccggcagcuacagcgccgagcacuuccagcac

SEQ ID NO: 36949 - RNA, 60 nt, Artificial Sequence
  derived and/or modified sequence opt4 from anti-HIV_CDR
cacgaggcccccagauacagcuacgccuucagaagauacuaccacuacggccuggacgug

SEQ ID NO: 36950 - RNA, 60 nt, Artificial Sequence
  derived and/or modified sequence opt4 from anti-HIV_CDR
accagcaccuacgaccaguggagcggccugcaccacgacggcgugauggccuucagcagc

SEQ ID NO: 36951 - RNA, 60 nt, Artificial Sequence
  derived and/or modified sequence opt4 from anti-HIV_CDR
ggcgaguucgacagcagcggcuucgacuacgagagcugguaccccuacuacauggacgug

SEQ ID NO: 36952 - RNA, 60 nt, Artificial Sequence
  derived and/or modified sequence opt4 from anti-HIV_CDR
ggccagaccgaccugaacgacgacuucuggagcgaguacagcacccccggcuucgacuac

SEQ ID NO: 36953 - RNA, 60 nt, Artificial Sequence
  derived and/or modified sequence opt4 from anti-HIV_CDR
ggccagaccgaccugaacgacgaccuguggagcgacuacagcacccccggcuucgacuac

SEQ ID NO: 36954 - RNA, 60 nt, Artificial Sequence
  derived and/or modified sequence opt4 from anti-HIV_CDR
aaccugaucgaggagagccagacccagcaggagaucaacgagagagaccugcuggcccug

SEQ ID NO: 36955 - RNA, 60 nt, Artificial Sequence
  derived and/or modified sequence opt4 from anti-HIV_CDR
aaccugaucgaggagagccagauccagcaggagaagaacgagaaggagcugcuggagcug

SEQ ID NO: 36956 - RNA, 60 nt, Artificial Sequence
  derived and/or modified sequence opt4 from anti-HIV_CDR
agccugaucgagaacagccagauccagcaggagaagaacgagcaggaccugcugcagcug

SEQ ID NO: 36957 - RNA, 60 nt, Artificial Sequence
  derived and/or modified sequence opt4 from anti-HIV_CDR
agccugaucgaggagagccagauccagcaggagaagaacgagaaggagcugcuggagcug

SEQ ID NO: 36958 - RNA, 60 nt, Artificial Sequence
  derived and/or modified sequence opt4 from anti-HIV_CDR
agacugaucgaggagagccagacccagcaggagaagaacgagcaggagcugcuggagcug

SEQ ID NO: 36959 - RNA, 60 nt, Artificial Sequence
  derived and/or modified sequence opt4 from anti-HIV_CDR
agccugaucgaggagagccagacccagcaggagaagaacgagaaggagcugcuggagcug

SEQ ID NO: 36960 - RNA, 60 nt, Artificial Sequence
  derived and/or modified sequence opt4 from anti-HIV_CDR
aaccugcuggaggagagccagaaccagcaggagaagaacgagcaggagcugcuggagcug

SEQ ID NO: 36961 - RNA, 60 nt, Artificial Sequence
  derived and/or modified sequence opt4 from anti-HIV_CDR
acccugaucgaggagagccagaaccagcaggagaagaacgagcuggagcugcuggagcug

SEQ ID NO: 36962 - RNA, 60 nt, Artificial Sequence
  derived and/or modified sequence opt4 from anti-HIV_CDR
acccugcaggaggagagccagaaccagcaggagaagaacgagcaggagcugcuggagcug

SEQ ID NO: 36963 - RNA, 60 nt, Artificial Sequence
  derived and/or modified sequence opt4 from anti-HIV_CDR
agccugcuggaggagagccagaaccagcaggagaagaacgagcaggagcugcuggagcug

SEQ ID NO: 36964 - RNA, 60 nt, Artificial Sequence
  derived and/or modified sequence opt4 from anti-HIV_CDR
acccugaucgaggagagccagaaccagcaggagaagaaccagcaggagcugcugcagcug

SEQ ID NO: 36965 - RNA, 60 nt, Artificial Sequence
  derived and/or modified sequence opt4 from anti-HIV_CDR
acccugaucgaggagagccagaaccagcaggagaagaacgagcaggagcugcugggccug

SEQ ID NO: 36966 - RNA, 60 nt, Artificial Sequence
  derived and/or modified sequence opt4 from anti-HIV_CDR
acccugaucgaggagagccagaaccagcaggagaagaacgagcaggagcugcuggagcug

SEQ ID NO: 36967 - RNA, 60 nt, Artificial Sequence
  derived and/or modified sequence opt4 from anti-HIV_CDR
agccugaucgaggacagccagauccagcaggagaagaacgagaaggagcugcuggagcug

SEQ ID NO: 36968 - RNA, 60 nt, Artificial Sequence
  derived and/or modified sequence opt4 from anti-HIV_CDR
agccugcuggagaagagccagacccagcaggagaagaacgagcaggagcugcuggagcug

SEQ ID NO: 36969 - RNA, 60 nt, Artificial Sequence
  derived and/or modified sequence opt4 from anti-HIV_CDR
agccugaucgaggagagccagaaccagcaggagaagaacgagcaggagcugcuggagcug

SEQ ID NO: 36970 - RNA, 60 nt, Artificial Sequence
  derived and/or modified sequence opt4 from anti-HIV_CDR
ggcgaccugcugggcuacaccgacagcugguacgaguucgacuacuacuacauggacgug

SEQ ID NO: 36971 - RNA, 60 nt, Artificial Sequence
  derived and/or modified sequence opt4 from anti-HIV_CDR
gacaccaacggcaccgagaucuucagacccggcggcggcgacaugagagacaacuggaga

SEQ ID NO: 36972 - RNA, 60 nt, Artificial Sequence
  derived and/or modified sequence opt4 from anti-HIV_CDR
gacgugguggagagacccggcuucggcgacuucagauacgacuacuacggcauggacgug

SEQ ID NO: 36973 - RNA, 60 nt, Artificial Sequence
  derived and/or modified sequence opt4 from anti-HIV_CDR
gaccagagagacugcagcaccaacagaugcuucggcguguucggcuacuacauggacgug

SEQ ID NO: 36974 - RNA, 60 nt, Artificial Sequence
  derived and/or modified sequence opt4 from anti-HIV_CDR
gacagaugggugagaccccaguuccccagcauggacuuccaguacaacggccuggacgug

SEQ ID NO: 36975 - RNA, 60 nt, Artificial Sequence
  derived and/or modified sequence opt4 from anti-HIV_CDR
gacagcggcuucgaccuggacuacuacgacaccaacgagcuguacuucggcuucgacuac

SEQ ID NO: 36976 - RNA, 60 nt, Artificial Sequence
  derived and/or modified sequence opt4 from anti-HIV_CDR
aaguaccccgccuacuacgacauccugaccgccaacuacagaagcuacuacuucgacuac

SEQ ID NO: 36977 - RNA, 60 nt, Artificial Sequence
  derived and/or modified sequence opt4 from anti-HIV_CDR
aaguaccccgccuacuacgacauccugaccggcuacuacagaaacuacuacuucgacuac

SEQ ID NO: 36978 - RNA, 60 nt, Artificial Sequence
  derived and/or modified sequence opt4 from anti-HIV_CDR
agagugaaguucccccugugguucggcgagaccaccuacuacuacuacggcauggacgug

SEQ ID NO: 36979 - RNA, 60 nt, Artificial Sequence
  derived and/or modified sequence opt4 from anti-HIV_CDR
gagagaagcaccaaguacagcuucuggagcgccgugaugagacccgacgccuucgaccug

SEQ ID NO: 36980 - RNA, 60 nt, Artificial Sequence
  derived and/or modified sequence opt4 from anti-HIV_CDR
cacgaggcccccagauacagcuacgccuucagaaacuacuaccacuacggccuggacgug

SEQ ID NO: 36981 - RNA, 60 nt, Artificial Sequence
  derived and/or modified sequence opt4 from anti-HIV_CDR
gagaacgugcugauggagagcgacgacuacaacgacuacuacuacuacuacauggacgug

SEQ ID NO: 36982 - RNA, 60 nt, Artificial Sequence
  derived and/or modified sequence opt4 from anti-HIV_CDR
gagagagugcugguguuccccgaccaggacgccgacuacuacuacuacuucuucgacgug

SEQ ID NO: 36983 - RNA, 60 nt, Artificial Sequence
  derived and/or modified sequence opt4 from anti-HIV_CDR
gagagagugcugguggugcccgaccaggacgccgacuacuacuacuacuucuucgacgug

SEQ ID NO: 36984 - RNA, 63 nt, Artificial Sequence
  derived and/or modified sequence opt4 from anti-HIV_CDR
gacagaagcagcgccaucggcuacugcagcagcaucagcugcuacaagggcagcuucgacauc

SEQ ID NO: 36985 - RNA, 63 nt, Artificial Sequence
  derived and/or modified sequence opt4 from anti-HIV_CDR
guggugaagaucgagccccugggcguggcccccaccaaggccaagagaguggccagagagaag

SEQ ID NO: 36986 - RNA, 63 nt, Artificial Sequence
  derived and/or modified sequence opt4 from anti-HIV_CDR
guggugagaaucgagccccugggcguggcccccaccaaggccaagagaguggagagagagaag

SEQ ID NO: 36987 - RNA, 63 nt, Artificial Sequence
  derived and/or modified sequence opt4 from anti-HIV_CDR
guggugagaaucgagccccugggcaucgcccccaccagagccaagagaguggagagagagaag

SEQ ID NO: 36988 - RNA, 63 nt, Artificial Sequence
  derived and/or modified sequence opt4 from anti-HIV_CDR
guggugaagaucgagcccaucggcguggcccccaccaaggccagaagaguggagagagagaag

SEQ ID NO: 36989 - RNA, 63 nt, Artificial Sequence
  derived and/or modified sequence opt4 from anti-HIV_CDR
guggugaagaucgagccccugggcguggcccccaccagagccaagagaguggagagagagaag

SEQ ID NO: 36990 - RNA, 63 nt, Artificial Sequence
  derived and/or modified sequence opt4 from anti-HIV_CDR
guggugcagaucgagccccugggcguggcccccaccagagccaagagaguggagagagagaag

SEQ ID NO: 36991 - RNA, 63 nt, Artificial Sequence
  derived and/or modified sequence opt4 from anti-HIV_CDR
guggugagaaucgagccccugggcguggcccccaccaaggccaagagagugcagagagagaag

SEQ ID NO: 36992 - RNA, 63 nt, Artificial Sequence
  derived and/or modified sequence opt4 from anti-HIV_CDR
guggugaagaucgagccccugggcguggcccccaccaaggccaagagagugcagagaaagaag

SEQ ID NO: 36993 - RNA, 63 nt, Artificial Sequence
  derived and/or modified sequence opt4 from anti-HIV_CDR
gugaucaagaucgagccccugaucguggcccccaccaaggccaagagagugcagagagagaag

SEQ ID NO: 36994 - RNA, 63 nt, Artificial Sequence
  derived and/or modified sequence opt4 from anti-HIV_CDR
guggugaagaucgagccccugggcguggcccccaccaaggccagaagagugcagagagagaag

SEQ ID NO: 36995 - RNA, 63 nt, Artificial Sequence
  derived and/or modified sequence opt4 from anti-HIV_CDR
guggugaagaucgagcugcugggcguggcccccaccaaggccaagagagugcagagagagaag

SEQ ID NO: 36996 - RNA, 63 nt, Artificial Sequence
  derived and/or modified sequence opt4 from anti-HIV_CDR
guggugaccaucgagccccugggcguggcccccaccaaggccaagagagugcagagagagaag

SEQ ID NO: 36997 - RNA, 63 nt, Artificial Sequence
  derived and/or modified sequence opt4 from anti-HIV_CDR
guggugaagaucgagccccugggcguggcccccaccaaggccaagagagugcagagagagaag

SEQ ID NO: 36998 - RNA, 63 nt, Artificial Sequence
  derived and/or modified sequence opt4 from anti-HIV_CDR
gaccuggugagcgugagcccccccuacggcaacuacggccccgacaacaacugguucgacuuc

SEQ ID NO: 36999 - RNA, 63 nt, Artificial Sequence
  derived and/or modified sequence opt4 from anti-HIV_CDR
augaacccccccugguucagaggcggcagcaacaaccccuacagcuacuacuacauggacgug

SEQ ID NO: 37000 - RNA, 63 nt, Artificial Sequence
  derived and/or modified sequence opt4 from anti-HIV_CDR
gacuggaucggcuacgacuacgacggcagcggcagccaccugagagacgagagcuucgacauc

SEQ ID NO: 37001 - RNA, 63 nt, Artificial Sequence
  derived and/or modified sequence opt4 from anti-HIV_CDR
ugcagcaucgugggcaacggcgacuuccuggaggaggacagccacuaccccgccauggacgug

SEQ ID NO: 37002 - RNA, 63 nt, Artificial Sequence
  derived and/or modified sequence opt4 from anti-HIV_CDR
gacuucgugagcaucuacggcguggccuacuucaccggcggcggccccagcagccccgacauc

SEQ ID NO: 37003 - RNA, 66 nt, Artificial Sequence
  derived and/or modified sequence opt4 from anti-HIV_CDR
aaggccaaggacuacuacuacgagagcagcgacuacagccccuacuacuacuacuacauggacgug

SEQ ID NO: 37004 - RNA, 66 nt, Artificial Sequence
  derived and/or modified sequence opt4 from anti-HIV_CDR
gaccacggcaucaagcccgacaacuacuacgacaucagcggcuacaaccuggacuacuucgacuac

SEQ ID NO: 37005 - RNA, 66 nt, Artificial Sequence
  derived and/or modified sequence opt4 from anti-HIV_CDR
ggcagccuguacgacuacagagacaacgccgaccugaagcccagcuacuacuacgccauggacgug

SEQ ID NO: 37006 - RNA, 66 nt, Artificial Sequence
  derived and/or modified sequence opt4 from anti-HIV_CDR
gacgaggccagcuggguggaggccgccgacgagugggacgagcaccuguucagagagauggccgug

SEQ ID NO: 37007 - RNA, 66 nt, Artificial Sequence
  derived and/or modified sequence opt4 from anti-HIV_CDR
gacgaggugagcuggguggaggccgccgacgagugggacgagcaccuguucagagagauggccgug

SEQ ID NO: 37008 - RNA, 66 nt, Artificial Sequence
  derived and/or modified sequence opt4 from anti-HIV_CDR
gacgagggcagcuggguggaggccgccgacgagugggacgagcaccuguucagagagauggccgug

SEQ ID NO: 37009 - RNA, 66 nt, Artificial Sequence
  derived and/or modified sequence opt4 from anti-HIV_CDR
gaccagagaggcagauacagcuucggcuucgugaccggccagaccaaggugagcgccaucagcgac

SEQ ID NO: 37010 - RNA, 66 nt, Artificial Sequence
  derived and/or modified sequence opt4 from anti-HIV_CDR
gaccagcugggcagauacagcuucggcuucgugaccggccagaacaaggugagcgccaucagcgac

SEQ ID NO: 37011 - RNA, 66 nt, Artificial Sequence
  derived and/or modified sequence opt4 from anti-HIV_CDR
gaccaggugggcagauacagcuucggcuucgccaccggccagcagagagugagcgccaucagcgac

SEQ ID NO: 37012 - RNA, 69 nt, Artificial Sequence
  derived and/or modified sequence opt4 from anti-HIV_CDR
guggugaagaucgagccccugggcguggcccccaccaaggccaagagaagaguggugcagagagagaag

SEQ ID NO: 37013 - RNA, 69 nt, Artificial Sequence
  derived and/or modified sequence opt4 from anti-HIV_CDR
agaaucagcagcagcagcugguacaugguggacaacagccacacccugcacuucuacuacauggacgug

SEQ ID NO: 37014 - RNA, 69 nt, Artificial Sequence
  derived and/or modified sequence opt4 from anti-HIV_CDR
gacaagcccgccuacgacgaguacgccgaggagaccaucgccccccacaacuaccacgccauggaccug

SEQ ID NO: 37015 - RNA, 69 nt, Artificial Sequence
  derived and/or modified sequence opt4 from anti-HIV_CDR
cagaacaucgccgccagagccgccgagaagcuguacgagaacgacuacuacuucuacggcauggacgug

SEQ ID NO: 37016 - RNA, 69 nt, Artificial Sequence
  derived and/or modified sequence opt4 from anti-HIV_CDR
cagaacaucgccgccagaaccgccgagagacuguacgagaacgacuacuacuucuacggcauggacgug

SEQ ID NO: 37017 - RNA, 72 nt, Artificial Sequence
  derived and/or modified sequence opt4 from anti-HIV_CDR
gcccagcagggcaagagaaucuacggcaucgugagcuucggcgaguucuucuacuacuacuacauggacgcc

SEQ ID NO: 37018 - RNA, 72 nt, Artificial Sequence
  derived and/or modified sequence opt4 from anti-HIV_CDR
acccagcagggcaagagaaucuacggcguggugagcuucggcgaguucuuccacuacuacuacauggacgcc

SEQ ID NO: 37019 - RNA, 72 nt, Artificial Sequence
  derived and/or modified sequence opt4 from anti-HIV_CDR
gccagaagaggccagagaaucuacggcguggugagcuucggcgaguucuucuacuacuacagcauggacgug

SEQ ID NO: 37020 - RNA, 72 nt, Artificial Sequence
  derived and/or modified sequence opt4 from anti-HIV_CDR
acccugcacggcagaagaaucuacggcaucguggccuucaacgagugguucaccuacuucuacauggacgug

SEQ ID NO: 37021 - RNA, 72 nt, Artificial Sequence
  derived and/or modified sequence opt4 from anti-HIV_CDR
accaagcacggcagaagaaucuacggcaucguggccuucaacgagugguucaccuacuucuacauggacgug

SEQ ID NO: 37022 - RNA, 72 nt, Artificial Sequence
  derived and/or modified sequence opt4 from anti-HIV_CDR
gccagacacggccagagaaucuacggcguggugagcuucggcgaguucuucaccuacuacagcauggacgug

SEQ ID NO: 37023 - RNA, 72 nt, Artificial Sequence
  derived and/or modified sequence opt4 from anti-HIV_CDR
acccagcagggcaagagaaucuacggcguggugagcuucggcgacuacuacuacuacuacuacauggacgug

SEQ ID NO: 37024 - RNA, 72 nt, Artificial Sequence
  derived and/or modified sequence opt4 from anti-HIV_CDR
accaagcacggcagaagaaucuacggcgugguggccuucggcgagugguucaccuacuucuacauggacgug

SEQ ID NO: 37025 - RNA, 72 nt, Artificial Sequence
  derived and/or modified sequence opt4 from anti-HIV_CDR
gccgugaucaccgaccugcacaccuucggcgacuacgagcuggaggaccccagcuacuacuacauggacgug

SEQ ID NO: 37026 - RNA, 72 nt, Artificial Sequence
  derived and/or modified sequence opt4 from anti-HIV_CDR
gacagaggcgacaccagacugcuggacuacggcgacuacgaggacgagagauacuacuacggcauggacgug

SEQ ID NO: 37027 - RNA, 72 nt, Artificial Sequence
  derived and/or modified sequence opt4 from anti-HIV_CDR
ggcaccagauacgacuucuggagcggcuucagcaacagagacggcagagcccuggccggcuacuucgacuac

SEQ ID NO: 37028 - RNA, 72 nt, Artificial Sequence
  derived and/or modified sequence opt4 from anti-HIV_CDR
gacggcaagggcaaggccuacuacgacuucuggagcggcuacagaaaccagaaguacuacggccuggacgug

SEQ ID NO: 37029 - RNA, 72 nt, Artificial Sequence
  derived and/or modified sequence opt4 from anti-HIV_CDR
gccgugaucaccgaccugcacaccuucgccgacuacgagcugggcgaccccagcuacuucuacauggacgug

SEQ ID NO: 37030 - RNA, 72 nt, Artificial Sequence
  derived and/or modified sequence opt4 from anti-HIV_CDR
agcgugaucaccgaccugcacaccuucggcgacuacgagagcggcgaccccagcuacuacuacauggacgug

SEQ ID NO: 37031 - RNA, 81 nt, Artificial Sequence
  derived and/or modified sequence opt4 from anti-HIV_CDR
gacuuccccagauuccacagacuggugggcaacuacgacuucuggagaggcacccuggacagauucagcuacauggaccug

SEQ ID NO: 37032 - RNA, 105 nt, Artificial Sequence
  derived and/or modified sequence opt4 from anti-HIV_CDR
agaauccuggccguggagagauaccugaaggaccagcagcugcugggcaucuggggcugcagcggcaagaucaucugccccaccauggugcccuggaacagcagc

SEQ ID NO: 37033 - RNA, 105 nt, Artificial Sequence
  derived and/or modified sequence opt4 from anti-HIV_CDR
agagugcuggccguggagagauaccugcaggaccagagacugcugggcauguggggcugcagcggcaagcacaucugcaccaccuucgugcccuggaacagcagc

SEQ ID NO: 37034 - RNA, 105 nt, Artificial Sequence
  derived and/or modified sequence opt4 from anti-HIV_CDR
agagugcuggccguggagagcuaccugaaggaccagcagcugcugggcaucuggggcugcagcggcaagcacaucugcaccaccaccgugcccuggaacagcagc

SEQ ID NO: 37035 - RNA, 105 nt, Artificial Sequence
  derived and/or modified sequence opt4 from anti-HIV_CDR
agagugcuggccguggagagauaccugagagaccagcagcugcugggcaucuggggcugcagcggcagacacaucugcaccaccaacgugcccuggaacagcagc

SEQ ID NO: 37036 - RNA, 105 nt, Artificial Sequence
  derived and/or modified sequence opt4 from anti-HIV_CDR
agaauccuggccguggagagauaccugaaggaccagcagcugcugggcaucuggggcugcagcggcaagcugaucugcaccaccaccgugcccuggaacagcagc

SEQ ID NO: 37037 - RNA, 105 nt, Artificial Sequence
  derived and/or modified sequence opt4 from anti-HIV_CDR
agaauccuggccguggagagauaccugaaggaccagcagcugcugggcaucuggggcugcagcggcaagcacaucugcaccaccaacgugcccuggaacagcagc

SEQ ID NO: 37038 - RNA, 105 nt, Artificial Sequence
  derived and/or modified sequence opt4 from anti-HIV_CDR
agagugcuggccguggagagauaccugagagaccagcagcugcugggcaucuggggcugcagcggcaagcugaucugcaccaccaccgugcccuggaacgccagc

SEQ ID NO: 37039 - RNA, 105 nt, Artificial Sequence
  derived and/or modified sequence opt4 from anti-HIV_CDR
agagugcuggccguggagagauaccugagagaccagcagcugcugggcaucuggggcugcagcggcaagcugaucugcaccaccgccgugcccuggaacgccagc

SEQ ID NO: 37040 - RNA, 105 nt, Artificial Sequence
  derived and/or modified sequence opt4 from anti-HIV_CDR
agagugcuggccguggagagauaccugaaggaccagcagcugcugggcaucuggggcugcagcggcaagcugaucugcaccaccaccgugcccuggaacgccagc

SEQ ID NO: 37041 - RNA, 105 nt, Artificial Sequence
  derived and/or modified sequence opt4 from anti-HIV_CDR
agaauccuggccguggagagauaccugaaggaccagcagcugcugggcuucuggggcugcagcggcaagcugaucugcaccaccgccgugcccuggaacgccagc

SEQ ID NO: 37042 - RNA, 105 nt, Artificial Sequence
  derived and/or modified sequence opt4 from anti-HIV_CDR
agagugcuggccguggagagauaccugagagaccagcagcugcugggcaucuggggcugcagcggcaagcugaucugcaccaccaccgugcccuggaacaccagc

SEQ ID NO: 37043 - RNA, 105 nt, Artificial Sequence
  derived and/or modified sequence opt4 from anti-HIV_CDR
agagugcuggccguggagagauaccugaaggaccagcagcugcugggcaucuggggcugcagcggcaagcugaucugcaccaccgccgugcccuggaacgccagc

SEQ ID NO: 37044 - RNA, 105 nt, Artificial Sequence
  derived and/or modified sequence opt4 from anti-HIV_CDR
agagugcuggccguggagagauaccugaaggaccagcagcugcugggcuucuggggcugcagcggcaagcugaucugcaccaccaccgugcccuggaacgccagc

SEQ ID NO: 37045 - RNA, 105 nt, Artificial Sequence
  derived and/or modified sequence opt4 from anti-HIV_CDR
agaauccuggccguggagagauaccugaaggaccagcagcugcugggcaucuggggcugcagcggcaagcugaucugcaccaccgccgugcccuggaacgccagc

SEQ ID NO: 37046-37071 - skipped (26 entries)

SEQ ID NO: 37072 - RNA, 12 nt, Artificial Sequence
  derived and/or modified sequence opt4 from anti-influenza_CDR
gacgugcccgac

SEQ ID NO: 37073 - RNA, 12 nt, Artificial Sequence
  derived and/or modified sequence opt4 from anti-influenza_CDR
agacugagcggc

SEQ ID NO: 37074 - RNA, 12 nt, Artificial Sequence
  derived and/or modified sequence opt4 from anti-influenza_CDR
uucugggaccug

SEQ ID NO: 37075 - RNA, 15 nt, Artificial Sequence
  derived and/or modified sequence opt4 from anti-influenza_CDR
accggccugagaaac

SEQ ID NO: 37076 - RNA, 15 nt, Artificial Sequence
  derived and/or modified sequence opt4 from anti-influenza_CDR
cagcagagcagaacc

SEQ ID NO: 37077 - RNA, 15 nt, Artificial Sequence
  derived and/or modified sequence opt4 from anti-influenza_CDR
cagcugagcagaacc

SEQ ID NO: 37078 - RNA, 15 nt, Artificial Sequence
  derived and/or modified sequence opt4 from anti-influenza_CDR
agcaacuacaucacc

SEQ ID NO: 37079 - RNA, 15 nt, Artificial Sequence
  derived and/or modified sequence opt4 from anti-influenza_CDR
gacuacagcuggaac

SEQ ID NO: 37080 - RNA, 15 nt, Artificial Sequence
  derived and/or modified sequence opt4 from anti-influenza_CDR
aacuacgccuucagc

SEQ ID NO: 37081 - RNA, 15 nt, Artificial Sequence
  derived and/or modified sequence opt4 from anti-influenza_CDR
aagaacgccaucagc

SEQ ID NO: 37082 - RNA, 15 nt, Artificial Sequence
  derived and/or modified sequence opt4 from anti-influenza_CDR
agccacuggaugacc

SEQ ID NO: 37083 - RNA, 15 nt, Artificial Sequence
  derived and/or modified sequence opt4 from anti-influenza_CDR
aacuacgacaucaac

SEQ ID NO: 37084 - RNA, 15 nt, Artificial Sequence
  derived and/or modified sequence opt4 from anti-influenza_CDR
gacuacggcgugacc

SEQ ID NO: 37085 - RNA, 15 nt, Artificial Sequence
  derived and/or modified sequence opt4 from anti-influenza_CDR
aacuacggcaucaac

SEQ ID NO: 37086 - RNA, 15 nt, Artificial Sequence
  derived and/or modified sequence opt4 from anti-influenza_CDR
ggcuacaccaucacc

SEQ ID NO: 37087 - RNA, 15 nt, Artificial Sequence
  derived and/or modified sequence opt4 from anti-influenza_CDR
aacuacggcaucagc

SEQ ID NO: 37088 - RNA, 15 nt, Artificial Sequence
  derived and/or modified sequence opt4 from anti-influenza_CDR
gacgacuacuggacc

SEQ ID NO: 37089 - RNA, 15 nt, Artificial Sequence
  derived and/or modified sequence opt4 from anti-influenza_CDR
accuacgccaugcac

SEQ ID NO: 37090 - RNA, 15 nt, Artificial Sequence
  derived and/or modified sequence opt4 from anti-influenza_CDR
agcuacgccaugcac

SEQ ID NO: 37091 - RNA, 15 nt, Artificial Sequence
  derived and/or modified sequence opt4 from anti-influenza_CDR
agcuacuacuggaac

SEQ ID NO: 37092 - RNA, 15 nt, Artificial Sequence
  derived and/or modified sequence opt4 from anti-influenza_CDR
accuaccccguggcc

SEQ ID NO: 37093 - RNA, 15 nt, Artificial Sequence
  derived and/or modified sequence opt4 from anti-influenza_CDR
cacuacuucuggagc

SEQ ID NO: 37094 - RNA, 15 nt, Artificial Sequence
  derived and/or modified sequence opt4 from anti-influenza_CDR
gacuacuacuggacc

SEQ ID NO: 37095 - RNA, 15 nt, Artificial Sequence
  derived and/or modified sequence opt4 from anti-influenza_CDR
gacuacuacuggagc

SEQ ID NO: 37096 - RNA, 15 nt, Artificial Sequence
  derived and/or modified sequence opt4 from anti-influenza_CDR
ggcuacuacaugcac

SEQ ID NO: 37097 - RNA, 15 nt, Artificial Sequence
  derived and/or modified sequence opt4 from anti-influenza_CDR
agccacuacuggagc

SEQ ID NO: 37098 - RNA, 15 nt, Artificial Sequence
  derived and/or modified sequence opt4 from anti-influenza_CDR
aacuacuggaucggc

SEQ ID NO: 37099 - RNA, 15 nt, Artificial Sequence
  derived and/or modified sequence opt4 from anti-influenza_CDR
aacuacgccaucauc

SEQ ID NO: 37100 - RNA, 15 nt, Artificial Sequence
  derived and/or modified sequence opt4 from anti-influenza_CDR
gacuacuacauccac

SEQ ID NO: 37101 - RNA, 15 nt, Artificial Sequence
  derived and/or modified sequence opt4 from anti-influenza_CDR
ggcuacgacaugcac

SEQ ID NO: 37102 - RNA, 15 nt, Artificial Sequence
  derived and/or modified sequence opt4 from anti-influenza_CDR
ggcuacuacauccac

SEQ ID NO: 37103 - RNA, 15 nt, Artificial Sequence
  derived and/or modified sequence opt4 from anti-influenza_CDR
ggcuacuacgugcac

SEQ ID NO: 37104 - RNA, 15 nt, Artificial Sequence
  derived and/or modified sequence opt4 from anti-influenza_CDR
aacuacuggaugagc

SEQ ID NO: 37105 - RNA, 15 nt, Artificial Sequence
  derived and/or modified sequence opt4 from anti-influenza_CDR
ggcgagagcacccug

SEQ ID NO: 37106 - RNA, 15 nt, Artificial Sequence
  derived and/or modified sequence opt4 from anti-influenza_CDR
aacuacuacuggagc

SEQ ID NO: 37107 - RNA, 15 nt, Artificial Sequence
  derived and/or modified sequence opt4 from anti-influenza_CDR
agcaacuacaugagc

SEQ ID NO: 37108 - RNA, 15 nt, Artificial Sequence
  derived and/or modified sequence opt4 from anti-influenza_CDR
agcgacuacuggagc

SEQ ID NO: 37109 - RNA, 15 nt, Artificial Sequence
  derived and/or modified sequence opt4 from anti-influenza_CDR
agcuacaacuggauc

SEQ ID NO: 37110 - RNA, 15 nt, Artificial Sequence
  derived and/or modified sequence opt4 from anti-influenza_CDR
agcaccuacaugaac

SEQ ID NO: 37111 - RNA, 15 nt, Artificial Sequence
  derived and/or modified sequence opt4 from anti-influenza_CDR
aacuacgccaugagc

SEQ ID NO: 37112 - RNA, 15 nt, Artificial Sequence
  derived and/or modified sequence opt4 from anti-influenza_CDR
agcgacuucuggagc

SEQ ID NO: 37113 - RNA, 15 nt, Artificial Sequence
  derived and/or modified sequence opt4 from anti-influenza_CDR
uacuacgccaugagc

SEQ ID NO: 37114 - RNA, 15 nt, Artificial Sequence
  derived and/or modified sequence opt4 from anti-influenza_CDR
ggcuacuacguguac

SEQ ID NO: 37115 - RNA, 15 nt, Artificial Sequence
  derived and/or modified sequence opt4 from anti-influenza_CDR
agcuacgccaucagc

SEQ ID NO: 37116 - RNA, 15 nt, Artificial Sequence
  derived and/or modified sequence opt4 from anti-influenza_CDR
agcuacagcuggagc

SEQ ID NO: 37117 - RNA, 15 nt, Artificial Sequence
  derived and/or modified sequence opt4 from anti-influenza_CDR
aacagcuucuggggc

SEQ ID NO: 37118 - RNA, 15 nt, Artificial Sequence
  derived and/or modified sequence opt4 from anti-influenza_CDR
gccuaccacuggagc

SEQ ID NO: 37119 - RNA, 15 nt, Artificial Sequence
  derived and/or modified sequence opt4 from anti-influenza_CDR
gacaacuacaucaac

SEQ ID NO: 37120 - RNA, 15 nt, Artificial Sequence
  derived and/or modified sequence opt4 from anti-influenza_CDR
agcggcuucagcgug

SEQ ID NO: 37121 - RNA, 15 nt, Artificial Sequence
  derived and/or modified sequence opt4 from anti-influenza_CDR
gccuacgccuucacc

SEQ ID NO: 37122 - RNA, 15 nt, Artificial Sequence
  derived and/or modified sequence opt4 from anti-influenza_CDR
ggcagcgccaucagc

SEQ ID NO: 37123 - RNA, 15 nt, Artificial Sequence
  derived and/or modified sequence opt4 from anti-influenza_CDR
agcuacgccaucacc

SEQ ID NO: 37124 - RNA, 15 nt, Artificial Sequence
  derived and/or modified sequence opt4 from anti-influenza_CDR
agcuacuacaugcac

SEQ ID NO: 37125 - RNA, 15 nt, Artificial Sequence
  derived and/or modified sequence opt4 from anti-influenza_CDR
aucuacgccaugagc

SEQ ID NO: 37126 - RNA, 15 nt, Artificial Sequence
  derived and/or modified sequence opt4 from anti-influenza_CDR
agcuacagcaugaac

SEQ ID NO: 37127 - RNA, 15 nt, Artificial Sequence
  derived and/or modified sequence opt4 from anti-influenza_CDR
agcuacggcaucagc

SEQ ID NO: 37128 - RNA, 15 nt, Artificial Sequence
  derived and/or modified sequence opt4 from anti-influenza_CDR
uucuacagcaugagc

SEQ ID NO: 37129 - RNA, 15 nt, Artificial Sequence
  derived and/or modified sequence opt4 from anti-influenza_CDR
acccacgccaucagc

SEQ ID NO: 37130 - RNA, 15 nt, Artificial Sequence
  derived and/or modified sequence opt4 from anti-influenza_CDR
ggcuacgccaucagc

SEQ ID NO: 37131 - RNA, 15 nt, Artificial Sequence
  derived and/or modified sequence opt4 from anti-influenza_CDR
agcaacagcaucagc

SEQ ID NO: 37132 - RNA, 15 nt, Artificial Sequence
  derived and/or modified sequence opt4 from anti-influenza_CDR
aacuucgccaucaac

SEQ ID NO: 37133 - RNA, 15 nt, Artificial Sequence
  derived and/or modified sequence opt4 from anti-influenza_CDR
agcaacgccgugagc

SEQ ID NO: 37134 - RNA, 15 nt, Artificial Sequence
  derived and/or modified sequence opt4 from anti-influenza_CDR
gacaacgccaucagc

SEQ ID NO: 37135 - RNA, 15 nt, Artificial Sequence
  derived and/or modified sequence opt4 from anti-influenza_CDR
uucagcgagguggag

SEQ ID NO: 37136 - RNA, 15 nt, Artificial Sequence
  derived and/or modified sequence opt4 from anti-influenza_CDR
gcccaccacaugcac

SEQ ID NO: 37137 - RNA, 15 nt, Artificial Sequence
  derived and/or modified sequence opt4 from anti-influenza_CDR
agccaguggaucggc

SEQ ID NO: 37138 - RNA, 15 nt, Artificial Sequence
  derived and/or modified sequence opt4 from anti-influenza_CDR
gacuacgccaugaac

SEQ ID NO: 37139 - RNA, 15 nt, Artificial Sequence
  derived and/or modified sequence opt4 from anti-influenza_CDR
aacgccuggaugagc

SEQ ID NO: 37140 - RNA, 15 nt, Artificial Sequence
  derived and/or modified sequence opt4 from anti-influenza_CDR
gacuacgccaucaac

SEQ ID NO: 37141 - RNA, 15 nt, Artificial Sequence
  derived and/or modified sequence opt4 from anti-influenza_CDR
agacacggcaucagc

SEQ ID NO: 37142 - RNA, 15 nt, Artificial Sequence
  derived and/or modified sequence opt4 from anti-influenza_CDR
gagcugagcauccac

SEQ ID NO: 37143 - RNA, 15 nt, Artificial Sequence
  derived and/or modified sequence opt4 from anti-influenza_CDR
agcagcaacuacuac

SEQ ID NO: 37144 - RNA, 15 nt, Artificial Sequence
  derived and/or modified sequence opt4 from anti-influenza_CDR
accuacgccaugagc

SEQ ID NO: 37145 - RNA, 15 nt, Artificial Sequence
  derived and/or modified sequence opt4 from anti-influenza_CDR
aacuacgccaucagc

SEQ ID NO: 37146 - RNA, 18 nt, Artificial Sequence
  derived and/or modified sequence opt4 from anti-influenza_CDR
uucggcgccaucgccggc

SEQ ID NO: 37147 - RNA, 18 nt, Artificial Sequence
  derived and/or modified sequence opt4 from anti-influenza_CDR
caggacaucagcagauac

SEQ ID NO: 37148 - RNA, 18 nt, Artificial Sequence
  derived and/or modified sequence opt4 from anti-influenza_CDR
cagaacaucggccccugg

SEQ ID NO: 37149 - RNA, 18 nt, Artificial Sequence
  derived and/or modified sequence opt4 from anti-influenza_CDR
cagagcgugaacagaaga

SEQ ID NO: 37150 - RNA, 18 nt, Artificial Sequence
  derived and/or modified sequence opt4 from anti-influenza_CDR
cagagcaucagcaccuac

SEQ ID NO: 37151 - RNA, 18 nt, Artificial Sequence
  derived and/or modified sequence opt4 from anti-influenza_CDR
cagggcaucaucaccuac

SEQ ID NO: 37152 - RNA, 18 nt, Artificial Sequence
  derived and/or modified sequence opt4 from anti-influenza_CDR
cagggcaucagcagcuac

SEQ ID NO: 37153 - RNA, 18 nt, Artificial Sequence
  derived and/or modified sequence opt4 from anti-influenza_CDR
caggacgugagcaccugg

SEQ ID NO: 37154 - RNA, 18 nt, Artificial Sequence
  derived and/or modified sequence opt4 from anti-influenza_CDR
caggacaucuacaucuac

SEQ ID NO: 37155 - RNA, 18 nt, Artificial Sequence
  derived and/or modified sequence opt4 from anti-influenza_CDR
gagaacaucuggaacaac

SEQ ID NO: 37156 - RNA, 18 nt, Artificial Sequence
  derived and/or modified sequence opt4 from anti-influenza_CDR
ggcuucaccgugaccagc

SEQ ID NO: 37157 - RNA, 18 nt, Artificial Sequence
  derived and/or modified sequence opt4 from anti-influenza_CDR
caggacaucagcggccac

SEQ ID NO: 37158 - RNA, 18 nt, Artificial Sequence
  derived and/or modified sequence opt4 from anti-influenza_CDR
agccugcugaccgaggug

SEQ ID NO: 37159 - RNA, 18 nt, Artificial Sequence
  derived and/or modified sequence opt4 from anti-influenza_CDR
ggcagcagcaucagcaac

SEQ ID NO: 37160 - RNA, 18 nt, Artificial Sequence
  derived and/or modified sequence opt4 from anti-influenza_CDR
ggcggcagcaucaccagc

SEQ ID NO: 37161 - RNA, 18 nt, Artificial Sequence
  derived and/or modified sequence opt4 from anti-influenza_CDR
ggcggcagcaucagcagc

SEQ ID NO: 37162 - RNA, 18 nt, Artificial Sequence
  derived and/or modified sequence opt4 from anti-influenza_CDR
ggccugagcgugagcagc

SEQ ID NO: 37163 - RNA, 18 nt, Artificial Sequence
  derived and/or modified sequence opt4 from anti-influenza_CDR
ggcgccagcaucagcagc

SEQ ID NO: 37164 - RNA, 18 nt, Artificial Sequence
  derived and/or modified sequence opt4 from anti-influenza_CDR
ggcgacagcaucagcagc

SEQ ID NO: 37165 - RNA, 18 nt, Artificial Sequence
  derived and/or modified sequence opt4 from anti-influenza_CDR
ggcggcagcaucagcaac

SEQ ID NO: 37166 - RNA, 18 nt, Artificial Sequence
  derived and/or modified sequence opt4 from anti-influenza_CDR
ggcggcagcaucagcgcc

SEQ ID NO: 37167 - RNA, 18 nt, Artificial Sequence
  derived and/or modified sequence opt4 from anti-influenza_CDR
ggcuucagcgugagcgac

SEQ ID NO: 37168 - RNA, 18 nt, Artificial Sequence
  derived and/or modified sequence opt4 from anti-influenza_CDR
agcagaagccuggacgug

SEQ ID NO: 37169 - RNA, 18 nt, Artificial Sequence
  derived and/or modified sequence opt4 from anti-influenza_CDR
agaagccagcagaccgug

SEQ ID NO: 37170 - RNA, 18 nt, Artificial Sequence
  derived and/or modified sequence opt4 from anti-influenza_CDR
cagaccaucaacaacuac

SEQ ID NO: 37171 - RNA, 18 nt, Artificial Sequence
  derived and/or modified sequence opt4 from anti-influenza_CDR
aacaugggccccaccagc

SEQ ID NO: 37172 - RNA, 18 nt, Artificial Sequence
  derived and/or modified sequence opt4 from anti-influenza_CDR
cagguggugggcaccaac

SEQ ID NO: 37173 - RNA, 18 nt, Artificial Sequence
  derived and/or modified sequence opt4 from anti-influenza_CDR
cagggcaucaacacccac

SEQ ID NO: 37174 - RNA, 18 nt, Artificial Sequence
  derived and/or modified sequence opt4 from anti-influenza_CDR
caggacaucagaaacaga

SEQ ID NO: 37175 - RNA, 18 nt, Artificial Sequence
  derived and/or modified sequence opt4 from anti-influenza_CDR
cagggcaucggcagcaac

SEQ ID NO: 37176 - RNA, 18 nt, Artificial Sequence
  derived and/or modified sequence opt4 from anti-influenza_CDR
cagaccaucuacagaugg

SEQ ID NO: 37177 - RNA, 18 nt, Artificial Sequence
  derived and/or modified sequence opt4 from anti-influenza_CDR
cagaccaucaccagauuc

SEQ ID NO: 37178 - RNA, 18 nt, Artificial Sequence
  derived and/or modified sequence opt4 from anti-influenza_CDR
agacugggcgagaaguuc

SEQ ID NO: 37179 - RNA, 18 nt, Artificial Sequence
  derived and/or modified sequence opt4 from anti-influenza_CDR
aagcugggcgacaaguuc

SEQ ID NO: 37180 - RNA, 18 nt, Artificial Sequence
  derived and/or modified sequence opt4 from anti-influenza_CDR
cagggccugggcagcaac

SEQ ID NO: 37181 - RNA, 18 nt, Artificial Sequence
  derived and/or modified sequence opt4 from anti-influenza_CDR
uacaucggcagcaagagc

SEQ ID NO: 37182 - RNA, 18 nt, Artificial Sequence
  derived and/or modified sequence opt4 from anti-influenza_CDR
cagcugaucagcagcuac

SEQ ID NO: 37183 - RNA, 18 nt, Artificial Sequence
  derived and/or modified sequence opt4 from anti-influenza_CDR
cagagcgugagcagcaac

SEQ ID NO: 37184 - RNA, 18 nt, Artificial Sequence
  derived and/or modified sequence opt4 from anti-influenza_CDR
caggugaucagcagcuac

SEQ ID NO: 37185 - RNA, 18 nt, Artificial Sequence
  derived and/or modified sequence opt4 from anti-influenza_CDR
cagagcgugaacagaaac

SEQ ID NO: 37186 - RNA, 18 nt, Artificial Sequence
  derived and/or modified sequence opt4 from anti-influenza_CDR
gacaucggcagcaagagc

SEQ ID NO: 37187 - RNA, 18 nt, Artificial Sequence
  derived and/or modified sequence opt4 from anti-influenza_CDR
cagagcgugagcaccaac

SEQ ID NO: 37188 - RNA, 18 nt, Artificial Sequence
  derived and/or modified sequence opt4 from anti-influenza_CDR
augaucgccggcuggcac

SEQ ID NO: 37189 - RNA, 18 nt, Artificial Sequence
  derived and/or modified sequence opt4 from anti-influenza_CDR
caggacaucagcaccugg

SEQ ID NO: 37190 - RNA, 18 nt, Artificial Sequence
  derived and/or modified sequence opt4 from anti-influenza_CDR
gagaagaucuacagcaac

SEQ ID NO: 37191 - RNA, 21 nt, Artificial Sequence
  derived and/or modified sequence opt4 from anti-influenza_CDR
aucuacuacaacuacaacauc

SEQ ID NO: 37192 - RNA, 21 nt, Artificial Sequence
  derived and/or modified sequence opt4 from anti-influenza_CDR
cagagcaucagcagcggcuac

SEQ ID NO: 37193 - RNA, 21 nt, Artificial Sequence
  derived and/or modified sequence opt4 from anti-influenza_CDR
cagagcgugagcagcagcuac

SEQ ID NO: 37194 - RNA, 21 nt, Artificial Sequence
  derived and/or modified sequence opt4 from anti-influenza_CDR
cagaccgugagcagcagcuac

SEQ ID NO: 37195 - RNA, 21 nt, Artificial Sequence
  derived and/or modified sequence opt4 from anti-influenza_CDR
agcaacaacgccguguggaac

SEQ ID NO: 37196 - RNA, 21 nt, Artificial Sequence
  derived and/or modified sequence opt4 from anti-influenza_CDR
agcaacagcgccguguggaac

SEQ ID NO: 37197 - RNA, 21 nt, Artificial Sequence
  derived and/or modified sequence opt4 from anti-influenza_CDR
gccgccaccacccugcagagc

SEQ ID NO: 37198 - RNA, 21 nt, Artificial Sequence
  derived and/or modified sequence opt4 from anti-influenza_CDR
agcaacagagccaccuggaac

SEQ ID NO: 37199 - RNA, 21 nt, Artificial Sequence
  derived and/or modified sequence opt4 from anti-influenza_CDR
gccaccagcacccugcagagc

SEQ ID NO: 37200 - RNA, 21 nt, Artificial Sequence
  derived and/or modified sequence opt4 from anti-influenza_CDR
agcaacagcgccaccuggaac

SEQ ID NO: 37201 - RNA, 21 nt, Artificial Sequence
  derived and/or modified sequence opt4 from anti-influenza_CDR
gccagcagcacccugcagagc

SEQ ID NO: 37202 - RNA, 21 nt, Artificial Sequence
  derived and/or modified sequence opt4 from anti-influenza_CDR
agcuacaacgccguguggaac

SEQ ID NO: 37203 - RNA, 21 nt, Artificial Sequence
  derived and/or modified sequence opt4 from anti-influenza_CDR
gccgccagcagcagacugagc

SEQ ID NO: 37204 - RNA, 21 nt, Artificial Sequence
  derived and/or modified sequence opt4 from anti-influenza_CDR
gccgccagcagcagaggcagc

SEQ ID NO: 37205 - RNA, 21 nt, Artificial Sequence
  derived and/or modified sequence opt4 from anti-influenza_CDR
aucuaccacagcggcagcgcc

SEQ ID NO: 37206 - RNA, 21 nt, Artificial Sequence
  derived and/or modified sequence opt4 from anti-influenza_CDR
aucuacuacagcggcgugacc

SEQ ID NO: 37207 - RNA, 21 nt, Artificial Sequence
  derived and/or modified sequence opt4 from anti-influenza_CDR
agcagcuaccuggccugguac

SEQ ID NO: 37208 - RNA, 21 nt, Artificial Sequence
  derived and/or modified sequence opt4 from anti-influenza_CDR
cagagccugagcagcagcagc

SEQ ID NO: 37209 - RNA, 21 nt, Artificial Sequence
  derived and/or modified sequence opt4 from anti-influenza_CDR
cagagcgugagcaucagcuac

SEQ ID NO: 37210 - RNA, 21 nt, Artificial Sequence
  derived and/or modified sequence opt4 from anti-influenza_CDR
gacgugaccgagagacccagc

SEQ ID NO: 37211 - RNA, 21 nt, Artificial Sequence
  derived and/or modified sequence opt4 from anti-influenza_CDR
gccgccagcacccugcuggac

SEQ ID NO: 37212 - RNA, 21 nt, Artificial Sequence
  derived and/or modified sequence opt4 from anti-influenza_CDR
gccgccagcacccugcacagc

SEQ ID NO: 37213 - RNA, 21 nt, Artificial Sequence
  derived and/or modified sequence opt4 from anti-influenza_CDR
ggcgccagcagccugcagggc

SEQ ID NO: 37214 - RNA, 21 nt, Artificial Sequence
  derived and/or modified sequence opt4 from anti-influenza_CDR
accaacggcgugaacgugggc

SEQ ID NO: 37215 - RNA, 21 nt, Artificial Sequence
  derived and/or modified sequence opt4 from anti-influenza_CDR
gacgccagcaccagagccacc

SEQ ID NO: 37216 - RNA, 21 nt, Artificial Sequence
  derived and/or modified sequence opt4 from anti-influenza_CDR
agcgagaccuacuacuggagc

SEQ ID NO: 37217 - RNA, 21 nt, Artificial Sequence
  derived and/or modified sequence opt4 from anti-influenza_CDR
gaggccgugaaccuggagagc

SEQ ID NO: 37218 - RNA, 21 nt, Artificial Sequence
  derived and/or modified sequence opt4 from anti-influenza_CDR
ggcgccagcaccagagccacc

SEQ ID NO: 37219 - RNA, 21 nt, Artificial Sequence
  derived and/or modified sequence opt4 from anti-influenza_CDR
gugagcggcuacuacuggagc

SEQ ID NO: 37220 - RNA, 21 nt, Artificial Sequence
  derived and/or modified sequence opt4 from anti-influenza_CDR
aucaccggcgugagagugggc

SEQ ID NO: 37221 - RNA, 21 nt, Artificial Sequence
  derived and/or modified sequence opt4 from anti-influenza_CDR
gacgccagcaacagagccacc

SEQ ID NO: 37222 - RNA, 21 nt, Artificial Sequence
  derived and/or modified sequence opt4 from anti-influenza_CDR
gaggugaccaacuggcccagc

SEQ ID NO: 37223 - RNA, 21 nt, Artificial Sequence
  derived and/or modified sequence opt4 from anti-influenza_CDR
aaggacagcgagagacccagc

SEQ ID NO: 37224 - RNA, 21 nt, Artificial Sequence
  derived and/or modified sequence opt4 from anti-influenza_CDR
agcggcaacuacuacuggaac

SEQ ID NO: 37225 - RNA, 21 nt, Artificial Sequence
  derived and/or modified sequence opt4 from anti-influenza_CDR
agcaccaccaucagacacagc

SEQ ID NO: 37226 - RNA, 21 nt, Artificial Sequence
  derived and/or modified sequence opt4 from anti-influenza_CDR
gacgacagcggcagacccagc

SEQ ID NO: 37227 - RNA, 21 nt, Artificial Sequence
  derived and/or modified sequence opt4 from anti-influenza_CDR
agaaacgaccugagacccagc

SEQ ID NO: 37228 - RNA, 21 nt, Artificial Sequence
  derived and/or modified sequence opt4 from anti-influenza_CDR
agcguggaccacuacuggagc

SEQ ID NO: 37229 - RNA, 21 nt, Artificial Sequence
  derived and/or modified sequence opt4 from anti-influenza_CDR
gccgugagcauccugcagagc

SEQ ID NO: 37230 - RNA, 21 nt, Artificial Sequence
  derived and/or modified sequence opt4 from anti-influenza_CDR
gacgacaccgacagacccagc

SEQ ID NO: 37231 - RNA, 21 nt, Artificial Sequence
  derived and/or modified sequence opt4 from anti-influenza_CDR
gagaacaacaagagacccagc

SEQ ID NO: 37232 - RNA, 21 nt, Artificial Sequence
  derived and/or modified sequence opt4 from anti-influenza_CDR
gacagcagcaacagagccccc

SEQ ID NO: 37233 - RNA, 21 nt, Artificial Sequence
  derived and/or modified sequence opt4 from anti-influenza_CDR
gaggugaccaagagacccagc

SEQ ID NO: 37234 - RNA, 21 nt, Artificial Sequence
  derived and/or modified sequence opt4 from anti-influenza_CDR
gccaccagcaacacccacagc

SEQ ID NO: 37235 - RNA, 21 nt, Artificial Sequence
  derived and/or modified sequence opt4 from anti-influenza_CDR
gccgccagcaaccuggagaac

SEQ ID NO: 37236 - RNA, 21 nt, Artificial Sequence
  derived and/or modified sequence opt4 from anti-influenza_CDR
gccgccagcggccugcagagc

SEQ ID NO: 37237 - RNA, 21 nt, Artificial Sequence
  derived and/or modified sequence opt4 from anti-influenza_CDR
ggcuucaccgugagcagcaac

SEQ ID NO: 37238 - RNA, 21 nt, Artificial Sequence
  derived and/or modified sequence opt4 from anti-influenza_CDR
ggcggcggcuacagcuggaac

SEQ ID NO: 37239 - RNA, 21 nt, Artificial Sequence
  derived and/or modified sequence opt4 from anti-influenza_CDR
ggcgccagcaaccugcagagc

SEQ ID NO: 37240 - RNA, 21 nt, Artificial Sequence
  derived and/or modified sequence opt4 from anti-influenza_CDR
ggcgccaccaaccugcagagc

SEQ ID NO: 37241 - RNA, 21 nt, Artificial Sequence
  derived and/or modified sequence opt4 from anti-influenza_CDR
ggcgccagcaaccugcacagc

SEQ ID NO: 37242 - RNA, 21 nt, Artificial Sequence
  derived and/or modified sequence opt4 from anti-influenza_CDR
ggcgccagcacccugcagagc

SEQ ID NO: 37243 - RNA, 21 nt, Artificial Sequence
  derived and/or modified sequence opt4 from anti-influenza_CDR
gacaacagcgacagacccagc

SEQ ID NO: 37244 - RNA, 21 nt, Artificial Sequence
  derived and/or modified sequence opt4 from anti-influenza_CDR
ggcgccagcagccugcagagc

SEQ ID NO: 37245 - RNA, 21 nt, Artificial Sequence
  derived and/or modified sequence opt4 from anti-influenza_CDR
ggcaacagcaacagacccagc

SEQ ID NO: 37246 - RNA, 21 nt, Artificial Sequence
  derived and/or modified sequence opt4 from anti-influenza_CDR
gccgccagcagccugcagagc

SEQ ID NO: 37247 - RNA, 21 nt, Artificial Sequence
  derived and/or modified sequence opt4 from anti-influenza_CDR
gccgccagcagccugcacagc

SEQ ID NO: 37248 - RNA, 21 nt, Artificial Sequence
  derived and/or modified sequence opt4 from anti-influenza_CDR
ggcgccagcacccugcagaac

SEQ ID NO: 37249 - RNA, 21 nt, Artificial Sequence
  derived and/or modified sequence opt4 from anti-influenza_CDR
ggcgccaccgaccugcagagc

SEQ ID NO: 37250 - RNA, 21 nt, Artificial Sequence
  derived and/or modified sequence opt4 from anti-influenza_CDR
agcggcgccuacuacuggacc

SEQ ID NO: 37251 - RNA, 21 nt, Artificial Sequence
  derived and/or modified sequence opt4 from anti-influenza_CDR
gugagcgacaacuacaucaac

SEQ ID NO: 37252 - RNA, 21 nt, Artificial Sequence
  derived and/or modified sequence opt4 from anti-influenza_CDR
ugggccagcaccagagagagc

SEQ ID NO: 37253 - RNA, 21 nt, Artificial Sequence
  derived and/or modified sequence opt4 from anti-influenza_CDR
agcaacaaccagagacccagc

SEQ ID NO: 37254 - RNA, 21 nt, Artificial Sequence
  derived and/or modified sequence opt4 from anti-influenza_CDR
gaggugagcaacagacccagc

SEQ ID NO: 37255 - RNA, 21 nt, Artificial Sequence
  derived and/or modified sequence opt4 from anti-influenza_CDR
aagaacacccagagacccagc

SEQ ID NO: 37256 - RNA, 21 nt, Artificial Sequence
  derived and/or modified sequence opt4 from anti-influenza_CDR
gacaacaacaagagacccagc

SEQ ID NO: 37257 - RNA, 21 nt, Artificial Sequence
  derived and/or modified sequence opt4 from anti-influenza_CDR
gacgccagcacccugagaagc

SEQ ID NO: 37258 - RNA, 21 nt, Artificial Sequence
  derived and/or modified sequence opt4 from anti-influenza_CDR
caggacaacagaagacccagc

SEQ ID NO: 37259 - RNA, 21 nt, Artificial Sequence
  derived and/or modified sequence opt4 from anti-influenza_CDR
gacgugagcaagagacccagc

SEQ ID NO: 37260 - RNA, 21 nt, Artificial Sequence
  derived and/or modified sequence opt4 from anti-influenza_CDR
gacgccagcagcagagccacc

SEQ ID NO: 37261 - RNA, 21 nt, Artificial Sequence
  derived and/or modified sequence opt4 from anti-influenza_CDR
cugggcagcaacagagccagc

SEQ ID NO: 37262 - RNA, 21 nt, Artificial Sequence
  derived and/or modified sequence opt4 from anti-influenza_CDR
ggcgccagcaccagagccgcc

SEQ ID NO: 37263 - RNA, 21 nt, Artificial Sequence
  derived and/or modified sequence opt4 from anti-influenza_CDR
gacgacagcgacagacccagc

SEQ ID NO: 37264 - RNA, 21 nt, Artificial Sequence
  derived and/or modified sequence opt4 from anti-influenza_CDR
agagacggccagagacccagc

SEQ ID NO: 37265 - RNA, 21 nt, Artificial Sequence
  derived and/or modified sequence opt4 from anti-influenza_CDR
ggcgccagcagcagagccacc

SEQ ID NO: 37266 - RNA, 21 nt, Artificial Sequence
  derived and/or modified sequence opt4 from anti-influenza_CDR
ggcgccagcagcagagccagc

SEQ ID NO: 37267 - RNA, 21 nt, Artificial Sequence
  derived and/or modified sequence opt4 from anti-influenza_CDR
gccgccagcacccugcagagc

SEQ ID NO: 37268 - RNA, 21 nt, Artificial Sequence
  derived and/or modified sequence opt4 from anti-influenza_CDR
cuggugagcaagagagccagc

SEQ ID NO: 37269 - RNA, 21 nt, Artificial Sequence
  derived and/or modified sequence opt4 from anti-influenza_CDR
gacgugaccuacagacccagc

SEQ ID NO: 37270 - RNA, 21 nt, Artificial Sequence
  derived and/or modified sequence opt4 from anti-influenza_CDR
augcaggcccuggagaccccc

SEQ ID NO: 37271 - RNA, 21 nt, Artificial Sequence
  derived and/or modified sequence opt4 from anti-influenza_CDR
cagaacuacggcagccccuuc

SEQ ID NO: 37272 - RNA, 21 nt, Artificial Sequence
  derived and/or modified sequence opt4 from anti-influenza_CDR
cagcaguacggcagccugccc

SEQ ID NO: 37273 - RNA, 21 nt, Artificial Sequence
  derived and/or modified sequence opt4 from anti-influenza_CDR
uggggcagcuaccuggagagc

SEQ ID NO: 37274 - RNA, 21 nt, Artificial Sequence
  derived and/or modified sequence opt4 from anti-influenza_CDR
agcgccagcaccagagccacc

SEQ ID NO: 37275 - RNA, 21 nt, Artificial Sequence
  derived and/or modified sequence opt4 from anti-influenza_CDR
ggcgccagcaccagagccagc

SEQ ID NO: 37276 - RNA, 21 nt, Artificial Sequence
  derived and/or modified sequence opt4 from anti-influenza_CDR
ggcgccagcaccagagacacc

SEQ ID NO: 37277 - RNA, 21 nt, Artificial Sequence
  derived and/or modified sequence opt4 from anti-influenza_CDR
aaggugagcacccuggagagc

SEQ ID NO: 37278 - RNA, 21 nt, Artificial Sequence
  derived and/or modified sequence opt4 from anti-influenza_CDR
agcaacaccgagagacccagc

SEQ ID NO: 37279 - RNA, 21 nt, Artificial Sequence
  derived and/or modified sequence opt4 from anti-influenza_CDR
aagaucagcaacagagacagc

SEQ ID NO: 37280 - RNA, 21 nt, Artificial Sequence
  derived and/or modified sequence opt4 from anti-influenza_CDR
agcgccagccacagauacagc

SEQ ID NO: 37281 - RNA, 21 nt, Artificial Sequence
  derived and/or modified sequence opt4 from anti-influenza_CDR
cagagcgugagaagcaacaac

SEQ ID NO: 37282 - RNA, 21 nt, Artificial Sequence
  derived and/or modified sequence opt4 from anti-influenza_CDR
cagagcgugagaagcggcuac

SEQ ID NO: 37283 - RNA, 21 nt, Artificial Sequence
  derived and/or modified sequence opt4 from anti-influenza_CDR
aucuacuacagaggcagcacc

SEQ ID NO: 37284 - RNA, 21 nt, Artificial Sequence
  derived and/or modified sequence opt4 from anti-influenza_CDR
guguacuacagcggcaucacc

SEQ ID NO: 37285 - RNA, 21 nt, Artificial Sequence
  derived and/or modified sequence opt4 from anti-influenza_CDR
agccacuucgccaaccugaag

SEQ ID NO: 37286 - RNA, 21 nt, Artificial Sequence
  derived and/or modified sequence opt4 from anti-influenza_CDR
cugaacaagagcaagcccuac

SEQ ID NO: 37287 - RNA, 21 nt, Artificial Sequence
  derived and/or modified sequence opt4 from anti-influenza_CDR
aagcuggccaacaccggcacc

SEQ ID NO: 37288 - RNA, 21 nt, Artificial Sequence
  derived and/or modified sequence opt4 from anti-influenza_CDR
gccgccagcacccugaccagc

SEQ ID NO: 37289 - RNA, 21 nt, Artificial Sequence
  derived and/or modified sequence opt4 from anti-influenza_CDR
gacgccagcaagcuggccagc

SEQ ID NO: 37290 - RNA, 21 nt, Artificial Sequence
  derived and/or modified sequence opt4 from anti-influenza_CDR
uucgccagcagacuggccagc

SEQ ID NO: 37291 - RNA, 21 nt, Artificial Sequence
  derived and/or modified sequence opt4 from anti-influenza_CDR
agcgccagcacccuggccagc

SEQ ID NO: 37292 - RNA, 21 nt, Artificial Sequence
  derived and/or modified sequence opt4 from anti-influenza_CDR
gaggugagccagagacccagc

SEQ ID NO: 37293 - RNA, 21 nt, Artificial Sequence
  derived and/or modified sequence opt4 from anti-influenza_CDR
ggcggcacccugaacaacuac

SEQ ID NO: 37294 - RNA, 21 nt, Artificial Sequence
  derived and/or modified sequence opt4 from anti-influenza_CDR
gacaucgugaugacccagagc

SEQ ID NO: 37295 - RNA, 24 nt, Artificial Sequence
  derived and/or modified sequence opt4 from anti-influenza_CDR
ggcuucaccuucagcaacuacgcc

SEQ ID NO: 37296 - RNA, 24 nt, Artificial Sequence
  derived and/or modified sequence opt4 from anti-influenza_CDR
ggcuucaccuucagcaacuacggc

SEQ ID NO: 37297 - RNA, 24 nt, Artificial Sequence
  derived and/or modified sequence opt4 from anti-influenza_CDR
ggcuucaccuucagcagcuacgcc

SEQ ID NO: 37298 - RNA, 24 nt, Artificial Sequence
  derived and/or modified sequence opt4 from anti-influenza_CDR
ggcuucaccuucagcaccuacgcc

SEQ ID NO: 37299 - RNA, 24 nt, Artificial Sequence
  derived and/or modified sequence opt4 from anti-influenza_CDR
ggcggcaucuucaucagccaggcc

SEQ ID NO: 37300 - RNA, 24 nt, Artificial Sequence
  derived and/or modified sequence opt4 from anti-influenza_CDR
ggcggcaucuucagccccuacgcc

SEQ ID NO: 37301 - RNA, 24 nt, Artificial Sequence
  derived and/or modified sequence opt4 from anti-influenza_CDR
ggcggccccuucagcggcuucgcc

SEQ ID NO: 37302 - RNA, 24 nt, Artificial Sequence
  derived and/or modified sequence opt4 from anti-influenza_CDR
ggcggcaccuucaacagccacgcc

SEQ ID NO: 37303 - RNA, 24 nt, Artificial Sequence
  derived and/or modified sequence opt4 from anti-influenza_CDR
ggcagcaacaucggcagcaacacc

SEQ ID NO: 37304 - RNA, 24 nt, Artificial Sequence
  derived and/or modified sequence opt4 from anti-influenza_CDR
ggcgugaccuucagcauguacgcc

SEQ ID NO: 37305 - RNA, 24 nt, Artificial Sequence
  derived and/or modified sequence opt4 from anti-influenza_CDR
ggcgugaccuucagcauguacacc

SEQ ID NO: 37306 - RNA, 24 nt, Artificial Sequence
  derived and/or modified sequence opt4 from anti-influenza_CDR
ggcgugaccagcagcaacuacccc

SEQ ID NO: 37307 - RNA, 24 nt, Artificial Sequence
  derived and/or modified sequence opt4 from anti-influenza_CDR
aucaucgccaucuucggcaccacc

SEQ ID NO: 37308 - RNA, 24 nt, Artificial Sequence
  derived and/or modified sequence opt4 from anti-influenza_CDR
aucaucccccuguucggcaccgcc

SEQ ID NO: 37309 - RNA, 24 nt, Artificial Sequence
  derived and/or modified sequence opt4 from anti-influenza_CDR
aucaucccccuguucggcaccacc

SEQ ID NO: 37310 - RNA, 24 nt, Artificial Sequence
  derived and/or modified sequence opt4 from anti-influenza_CDR
aucauccccauguucggcgccacc

SEQ ID NO: 37311 - RNA, 24 nt, Artificial Sequence
  derived and/or modified sequence opt4 from anti-influenza_CDR
aucauccccauguucggcaccacc

SEQ ID NO: 37312 - RNA, 24 nt, Artificial Sequence
  derived and/or modified sequence opt4 from anti-influenza_CDR
aucaacagcggcggcggcgccacc

SEQ ID NO: 37313 - RNA, 24 nt, Artificial Sequence
  derived and/or modified sequence opt4 from anti-influenza_CDR
aucagcgccguguucggcaccgcc

SEQ ID NO: 37314 - RNA, 24 nt, Artificial Sequence
  derived and/or modified sequence opt4 from anti-influenza_CDR
aucagcuacgacgccaacuacaag

SEQ ID NO: 37315 - RNA, 24 nt, Artificial Sequence
  derived and/or modified sequence opt4 from anti-influenza_CDR
aucagcuacgacggcaacuacaag

SEQ ID NO: 37316 - RNA, 24 nt, Artificial Sequence
  derived and/or modified sequence opt4 from anti-influenza_CDR
aucagcuacgacggcagcaacaag

SEQ ID NO: 37317 - RNA, 24 nt, Artificial Sequence
  derived and/or modified sequence opt4 from anti-influenza_CDR
aucagcuacgacggcagcaaccag

SEQ ID NO: 37318 - RNA, 24 nt, Artificial Sequence
  derived and/or modified sequence opt4 from anti-influenza_CDR
cagcaguacuacagaagccccagc

SEQ ID NO: 37319 - RNA, 24 nt, Artificial Sequence
  derived and/or modified sequence opt4 from anti-influenza_CDR
gugcugccccuguucggcgugacc

SEQ ID NO: 37320 - RNA, 24 nt, Artificial Sequence
  derived and/or modified sequence opt4 from anti-influenza_CDR
ggcggcaccuucagcagcgacgcc

SEQ ID NO: 37321 - RNA, 24 nt, Artificial Sequence
  derived and/or modified sequence opt4 from anti-influenza_CDR
aucauccccguguuccagaccgcc

SEQ ID NO: 37322 - RNA, 24 nt, Artificial Sequence
  derived and/or modified sequence opt4 from anti-influenza_CDR
accagcaacaucggcagcaacgcc

SEQ ID NO: 37323 - RNA, 24 nt, Artificial Sequence
  derived and/or modified sequence opt4 from anti-influenza_CDR
ggcuacagcuucaccagcagaugg

SEQ ID NO: 37324 - RNA, 24 nt, Artificial Sequence
  derived and/or modified sequence opt4 from anti-influenza_CDR
aucuaccccagcgacagcgacgug

SEQ ID NO: 37325 - RNA, 24 nt, Artificial Sequence
  derived and/or modified sequence opt4 from anti-influenza_CDR
cagcaguacgacaacuggcugagc

SEQ ID NO: 37326 - RNA, 24 nt, Artificial Sequence
  derived and/or modified sequence opt4 from anti-influenza_CDR
ggcggcaccuucagcaacuacggc

SEQ ID NO: 37327 - RNA, 24 nt, Artificial Sequence
  derived and/or modified sequence opt4 from anti-influenza_CDR
ggcgccagcaucagcagcagcuac

SEQ ID NO: 37328 - RNA, 24 nt, Artificial Sequence
  derived and/or modified sequence opt4 from anti-influenza_CDR
ggcggcaccuucagcagcuacgac

SEQ ID NO: 37329 - RNA, 24 nt, Artificial Sequence
  derived and/or modified sequence opt4 from anti-influenza_CDR
aucauccccaucuacggcaccgcc

SEQ ID NO: 37330 - RNA, 24 nt, Artificial Sequence
  derived and/or modified sequence opt4 from anti-influenza_CDR
ggcuacaccagcaccaccuacggc

SEQ ID NO: 37331 - RNA, 24 nt, Artificial Sequence
  derived and/or modified sequence opt4 from anti-influenza_CDR
aucaaccccuacaacggcaacccc

SEQ ID NO: 37332 - RNA, 24 nt, Artificial Sequence
  derived and/or modified sequence opt4 from anti-influenza_CDR
aucugguacgacggcgacaacaag

SEQ ID NO: 37333 - RNA, 24 nt, Artificial Sequence
  derived and/or modified sequence opt4 from anti-influenza_CDR
ggcuucaccuucagcgacuucugg

SEQ ID NO: 37334 - RNA, 24 nt, Artificial Sequence
  derived and/or modified sequence opt4 from anti-influenza_CDR
aucgaccaggacggcaacgagaga

SEQ ID NO: 37335 - RNA, 24 nt, Artificial Sequence
  derived and/or modified sequence opt4 from anti-influenza_CDR
agcagcaacaucggcaagaacuac

SEQ ID NO: 37336 - RNA, 24 nt, Artificial Sequence
  derived and/or modified sequence opt4 from anti-influenza_CDR
ggcuacaccuucaccaacuacugg

SEQ ID NO: 37337 - RNA, 24 nt, Artificial Sequence
  derived and/or modified sequence opt4 from anti-influenza_CDR
aucuucccccccgacagccagacc

SEQ ID NO: 37338 - RNA, 24 nt, Artificial Sequence
  derived and/or modified sequence opt4 from anti-influenza_CDR
ggcuacagcuucagcgacuacugg

SEQ ID NO: 37339 - RNA, 24 nt, Artificial Sequence
  derived and/or modified sequence opt4 from anti-influenza_CDR
aucuaccccgccagcagcgagauc

SEQ ID NO: 37340 - RNA, 24 nt, Artificial Sequence
  derived and/or modified sequence opt4 from anti-influenza_CDR
agcggcgacagcggcaccuggaac

SEQ ID NO: 37341 - RNA, 24 nt, Artificial Sequence
  derived and/or modified sequence opt4 from anti-influenza_CDR
ggcggcacccugaacaacuacgcc

SEQ ID NO: 37342 - RNA, 24 nt, Artificial Sequence
  derived and/or modified sequence opt4 from anti-influenza_CDR
aucagccccaucuucggcacccug

SEQ ID NO: 37343 - RNA, 24 nt, Artificial Sequence
  derived and/or modified sequence opt4 from anti-influenza_CDR
ggcguguucuucagcagccacgcc

SEQ ID NO: 37344 - RNA, 24 nt, Artificial Sequence
  derived and/or modified sequence opt4 from anti-influenza_CDR
aucagccccauguucggcaccacc

SEQ ID NO: 37345 - RNA, 24 nt, Artificial Sequence
  derived and/or modified sequence opt4 from anti-influenza_CDR
ggcuucaccuucagcagauucggc

SEQ ID NO: 37346 - RNA, 24 nt, Artificial Sequence
  derived and/or modified sequence opt4 from anti-influenza_CDR
aucugguacgacggcagcaacaag

SEQ ID NO: 37347 - RNA, 24 nt, Artificial Sequence
  derived and/or modified sequence opt4 from anti-influenza_CDR
cagaccuacggcggcgugagcacc

SEQ ID NO: 37348 - RNA, 24 nt, Artificial Sequence
  derived and/or modified sequence opt4 from anti-influenza_CDR
gacagcgccggcaacagacacagc

SEQ ID NO: 37349 - RNA, 24 nt, Artificial Sequence
  derived and/or modified sequence opt4 from anti-influenza_CDR
uucagaggcggcaacagccugagc

SEQ ID NO: 37350 - RNA, 24 nt, Artificial Sequence
  derived and/or modified sequence opt4 from anti-influenza_CDR
ggcuacaccuucaccaccuacugg

SEQ ID NO: 37351 - RNA, 24 nt, Artificial Sequence
  derived and/or modified sequence opt4 from anti-influenza_CDR
aucgaccccuacgacagcgagacc

SEQ ID NO: 37352 - RNA, 24 nt, Artificial Sequence
  derived and/or modified sequence opt4 from anti-influenza_CDR
aucagaaaguuccugaacugguac

SEQ ID NO: 37353 - RNA, 24 nt, Artificial Sequence
  derived and/or modified sequence opt4 from anti-influenza_CDR
cagcaguacgacggccugcccuuc

SEQ ID NO: 37354 - RNA, 24 nt, Artificial Sequence
  derived and/or modified sequence opt4 from anti-influenza_CDR
aucagaaacagccugaacugguac

SEQ ID NO: 37355 - RNA, 24 nt, Artificial Sequence
  derived and/or modified sequence opt4 from anti-influenza_CDR
cagcaggccaacagcuucccccug

SEQ ID NO: 37356 - RNA, 24 nt, Artificial Sequence
  derived and/or modified sequence opt4 from anti-influenza_CDR
agccugcugaccgagguggagacc

SEQ ID NO: 37357 - RNA, 24 nt, Artificial Sequence
  derived and/or modified sequence opt4 from anti-influenza_CDR
cagcagagcuacagcaugcccgcc

SEQ ID NO: 37358 - RNA, 24 nt, Artificial Sequence
  derived and/or modified sequence opt4 from anti-influenza_CDR
ggcggccccgugagcggcggcggc

SEQ ID NO: 37359 - RNA, 24 nt, Artificial Sequence
  derived and/or modified sequence opt4 from anti-influenza_CDR
cagcagagcuucagcgugcccgcc

SEQ ID NO: 37360 - RNA, 24 nt, Artificial Sequence
  derived and/or modified sequence opt4 from anti-influenza_CDR
cagcagaccuacagcaucccccug

SEQ ID NO: 37361 - RNA, 24 nt, Artificial Sequence
  derived and/or modified sequence opt4 from anti-influenza_CDR
cagcagagcuacagcgugcccgcc

SEQ ID NO: 37362 - RNA, 24 nt, Artificial Sequence
  derived and/or modified sequence opt4 from anti-influenza_CDR
cagcagaccuucagcaucccccug

SEQ ID NO: 37363 - RNA, 24 nt, Artificial Sequence
  derived and/or modified sequence opt4 from anti-influenza_CDR
ggcgacagcaucaccagcggcgcc

SEQ ID NO: 37364 - RNA, 24 nt, Artificial Sequence
  derived and/or modified sequence opt4 from anti-influenza_CDR
caggccugggacagcagcaccgcc

SEQ ID NO: 37365 - RNA, 24 nt, Artificial Sequence
  derived and/or modified sequence opt4 from anti-influenza_CDR
cagcaguacggcagcagccugugg

SEQ ID NO: 37366 - RNA, 24 nt, Artificial Sequence
  derived and/or modified sequence opt4 from anti-influenza_CDR
gccuacggcuacaccuucgacccc

SEQ ID NO: 37367 - RNA, 24 nt, Artificial Sequence
  derived and/or modified sequence opt4 from anti-influenza_CDR
augcaggcccugcagaccccccug

SEQ ID NO: 37368 - RNA, 24 nt, Artificial Sequence
  derived and/or modified sequence opt4 from anti-influenza_CDR
cagcaguacggcagcagccugacc

SEQ ID NO: 37369 - RNA, 24 nt, Artificial Sequence
  derived and/or modified sequence opt4 from anti-influenza_CDR
cagaaguacaacagcgcccccagc

SEQ ID NO: 37370 - RNA, 24 nt, Artificial Sequence
  derived and/or modified sequence opt4 from anti-influenza_CDR
cagcagagaagcaacuggcugaag

SEQ ID NO: 37371 - RNA, 24 nt, Artificial Sequence
  derived and/or modified sequence opt4 from anti-influenza_CDR
agcagccagagcagaagcagcacc

SEQ ID NO: 37372 - RNA, 24 nt, Artificial Sequence
  derived and/or modified sequence opt4 from anti-influenza_CDR
cccuacgacgugcccgacuacgag

SEQ ID NO: 37373 - RNA, 24 nt, Artificial Sequence
  derived and/or modified sequence opt4 from anti-influenza_CDR
cccuacgacgugcccgacuacgcc

SEQ ID NO: 37374 - RNA, 24 nt, Artificial Sequence
  derived and/or modified sequence opt4 from anti-influenza_CDR
cccggcgacuucaacgacuacgag

SEQ ID NO: 37375 - RNA, 24 nt, Artificial Sequence
  derived and/or modified sequence opt4 from anti-influenza_CDR
cccaaggugagagaccaggagagc

SEQ ID NO: 37376 - RNA, 24 nt, Artificial Sequence
  derived and/or modified sequence opt4 from anti-influenza_CDR
accagcuacaccagcagcaacacc

SEQ ID NO: 37377 - RNA, 24 nt, Artificial Sequence
  derived and/or modified sequence opt4 from anti-influenza_CDR
ggcggcaacuucaacaacuacgcc

SEQ ID NO: 37378 - RNA, 24 nt, Artificial Sequence
  derived and/or modified sequence opt4 from anti-influenza_CDR
aucagccccaucuucggcagcacc

SEQ ID NO: 37379 - RNA, 24 nt, Artificial Sequence
  derived and/or modified sequence opt4 from anti-influenza_CDR
agcagcuacaccagcagcaacacc

SEQ ID NO: 37380 - RNA, 24 nt, Artificial Sequence
  derived and/or modified sequence opt4 from anti-influenza_CDR
ggcggcaccuucaacaacuacgcc

SEQ ID NO: 37381 - RNA, 24 nt, Artificial Sequence
  derived and/or modified sequence opt4 from anti-influenza_CDR
aucagccccaucuucggcagcgug

SEQ ID NO: 37382 - RNA, 24 nt, Artificial Sequence
  derived and/or modified sequence opt4 from anti-influenza_CDR
agcagcaacaucggccacaacuuc

SEQ ID NO: 37383 - RNA, 24 nt, Artificial Sequence
  derived and/or modified sequence opt4 from anti-influenza_CDR
ggcaccugggacagcagccugagc

SEQ ID NO: 37384 - RNA, 24 nt, Artificial Sequence
  derived and/or modified sequence opt4 from anti-influenza_CDR
ggcggcaucaucagaaaguacgcc

SEQ ID NO: 37385 - RNA, 24 nt, Artificial Sequence
  derived and/or modified sequence opt4 from anti-influenza_CDR
aucaucgccaucuucaacaccgcc

SEQ ID NO: 37386 - RNA, 24 nt, Artificial Sequence
  derived and/or modified sequence opt4 from anti-influenza_CDR
ggcuacaccuucaccgccuacacc

SEQ ID NO: 37387 - RNA, 24 nt, Artificial Sequence
  derived and/or modified sequence opt4 from anti-influenza_CDR
aucaacgccggcaacggccacacc

SEQ ID NO: 37388 - RNA, 24 nt, Artificial Sequence
  derived and/or modified sequence opt4 from anti-influenza_CDR
ggcggcaccuucaucaacuacgcc

SEQ ID NO: 37389 - RNA, 24 nt, Artificial Sequence
  derived and/or modified sequence opt4 from anti-influenza_CDR
aucauccccguguacggcaccagc

SEQ ID NO: 37390 - RNA, 24 nt, Artificial Sequence
  derived and/or modified sequence opt4 from anti-influenza_CDR
ggcuucaccuucagaagccacgcc

SEQ ID NO: 37391 - RNA, 24 nt, Artificial Sequence
  derived and/or modified sequence opt4 from anti-influenza_CDR
aucagcuacgacgaggugaacaag

SEQ ID NO: 37392 - RNA, 24 nt, Artificial Sequence
  derived and/or modified sequence opt4 from anti-influenza_CDR
ggcuacaacuucgccgccuacuac

SEQ ID NO: 37393 - RNA, 24 nt, Artificial Sequence
  derived and/or modified sequence opt4 from anti-influenza_CDR
agcaaccccaacaccggcggcgcc

SEQ ID NO: 37394 - RNA, 24 nt, Artificial Sequence
  derived and/or modified sequence opt4 from anti-influenza_CDR
ggcuacacccugaucgacuacuac

SEQ ID NO: 37395 - RNA, 24 nt, Artificial Sequence
  derived and/or modified sequence opt4 from anti-influenza_CDR
aucaaccccaucaacggcggcacc

SEQ ID NO: 37396 - RNA, 24 nt, Artificial Sequence
  derived and/or modified sequence opt4 from anti-influenza_CDR
ggcuucaccuucagcgccuacgcc

SEQ ID NO: 37397 - RNA, 24 nt, Artificial Sequence
  derived and/or modified sequence opt4 from anti-influenza_CDR
accagcuacgacggcagagacagc

SEQ ID NO: 37398 - RNA, 24 nt, Artificial Sequence
  derived and/or modified sequence opt4 from anti-influenza_CDR
ggcuucaccuucaccaacuacgcc

SEQ ID NO: 37399 - RNA, 24 nt, Artificial Sequence
  derived and/or modified sequence opt4 from anti-influenza_CDR
aucagcuucgacgaggacaacaag

SEQ ID NO: 37400 - RNA, 24 nt, Artificial Sequence
  derived and/or modified sequence opt4 from anti-influenza_CDR
ggcuucaacuucagcagcuacggc

SEQ ID NO: 37401 - RNA, 24 nt, Artificial Sequence
  derived and/or modified sequence opt4 from anti-influenza_CDR
aucuggagcggcggcagcaacaag

SEQ ID NO: 37402 - RNA, 24 nt, Artificial Sequence
  derived and/or modified sequence opt4 from anti-influenza_CDR
ggcuucaucuucggcgacuucgcc

SEQ ID NO: 37403 - RNA, 24 nt, Artificial Sequence
  derived and/or modified sequence opt4 from anti-influenza_CDR
ggcuucaacuucgacgaguacgug

SEQ ID NO: 37404 - RNA, 24 nt, Artificial Sequence
  derived and/or modified sequence opt4 from anti-influenza_CDR
aucggcgccgacggcagaggcacc

SEQ ID NO: 37405 - RNA, 24 nt, Artificial Sequence
  derived and/or modified sequence opt4 from anti-influenza_CDR
ggcggcagcgugagcaacuacuac

SEQ ID NO: 37406 - RNA, 24 nt, Artificial Sequence
  derived and/or modified sequence opt4 from anti-influenza_CDR
ggcggcaccuucagcuacuacgcc

SEQ ID NO: 37407 - RNA, 24 nt, Artificial Sequence
  derived and/or modified sequence opt4 from anti-influenza_CDR
aucauccccaucgugggcaccgcc

SEQ ID NO: 37408 - RNA, 24 nt, Artificial Sequence
  derived and/or modified sequence opt4 from anti-influenza_CDR
accagcaacaucggcagcaacacc

SEQ ID NO: 37409 - RNA, 24 nt, Artificial Sequence
  derived and/or modified sequence opt4 from anti-influenza_CDR
ggcuacaacuuccccaaguacugg

SEQ ID NO: 37410 - RNA, 24 nt, Artificial Sequence
  derived and/or modified sequence opt4 from anti-influenza_CDR
aucuaccccggcgacagcgacgug

SEQ ID NO: 37411 - RNA, 24 nt, Artificial Sequence
  derived and/or modified sequence opt4 from anti-influenza_CDR
ggccacaccuucaucagcuacgcc

SEQ ID NO: 37412 - RNA, 24 nt, Artificial Sequence
  derived and/or modified sequence opt4 from anti-influenza_CDR
aucgugcccaucuucggcaccgug

SEQ ID NO: 37413 - RNA, 24 nt, Artificial Sequence
  derived and/or modified sequence opt4 from anti-influenza_CDR
ggcuucaccuucagaaccuacggc

SEQ ID NO: 37414 - RNA, 24 nt, Artificial Sequence
  derived and/or modified sequence opt4 from anti-influenza_CDR
aucagcuacgacggcaccaacaag

SEQ ID NO: 37415 - RNA, 24 nt, Artificial Sequence
  derived and/or modified sequence opt4 from anti-influenza_CDR
ggcuucaccuucagcagcuacggc

SEQ ID NO: 37416 - RNA, 24 nt, Artificial Sequence
  derived and/or modified sequence opt4 from anti-influenza_CDR
aucagcuacgacgagaucaacaag

SEQ ID NO: 37417 - RNA, 24 nt, Artificial Sequence
  derived and/or modified sequence opt4 from anti-influenza_CDR
ggcuucagccuguggaccagcggc

SEQ ID NO: 37418 - RNA, 24 nt, Artificial Sequence
  derived and/or modified sequence opt4 from anti-influenza_CDR
augagcuacgacgagaccaagaag

SEQ ID NO: 37419 - RNA, 24 nt, Artificial Sequence
  derived and/or modified sequence opt4 from anti-influenza_CDR
ggcuucaccuucagcagauacagc

SEQ ID NO: 37420 - RNA, 24 nt, Artificial Sequence
  derived and/or modified sequence opt4 from anti-influenza_CDR
aucagcgacaccagcagaaccauc

SEQ ID NO: 37421 - RNA, 24 nt, Artificial Sequence
  derived and/or modified sequence opt4 from anti-influenza_CDR
ggcuucaccuucaacagcuacgcc

SEQ ID NO: 37422 - RNA, 24 nt, Artificial Sequence
  derived and/or modified sequence opt4 from anti-influenza_CDR
aucagaggcagcggcgagaacacc

SEQ ID NO: 37423 - RNA, 24 nt, Artificial Sequence
  derived and/or modified sequence opt4 from anti-influenza_CDR
ggcuucaccuucagcagauucagc

SEQ ID NO: 37424 - RNA, 24 nt, Artificial Sequence
  derived and/or modified sequence opt4 from anti-influenza_CDR
aucagcgacaccggcagaaccauc

SEQ ID NO: 37425 - RNA, 24 nt, Artificial Sequence
  derived and/or modified sequence opt4 from anti-influenza_CDR
ggcgacagcuucaccagcuacugg

SEQ ID NO: 37426 - RNA, 24 nt, Artificial Sequence
  derived and/or modified sequence opt4 from anti-influenza_CDR
aucuaccccagagacagcgagacc

SEQ ID NO: 37427 - RNA, 24 nt, Artificial Sequence
  derived and/or modified sequence opt4 from anti-influenza_CDR
ggcuacaccuucaccgccuaccac

SEQ ID NO: 37428 - RNA, 24 nt, Artificial Sequence
  derived and/or modified sequence opt4 from anti-influenza_CDR
aucaaccccaacagcggcgccacc

SEQ ID NO: 37429 - RNA, 24 nt, Artificial Sequence
  derived and/or modified sequence opt4 from anti-influenza_CDR
ggcuucaccuucagcgacuacugg

SEQ ID NO: 37430 - RNA, 24 nt, Artificial Sequence
  derived and/or modified sequence opt4 from anti-influenza_CDR
aucagcagcgacggcagcaccacc

SEQ ID NO: 37431 - RNA, 24 nt, Artificial Sequence
  derived and/or modified sequence opt4 from anti-influenza_CDR
ggcuucagcuucagcaacgccugg

SEQ ID NO: 37432 - RNA, 24 nt, Artificial Sequence
  derived and/or modified sequence opt4 from anti-influenza_CDR
ggccugaccuucagcaacgccugg

SEQ ID NO: 37433 - RNA, 24 nt, Artificial Sequence
  derived and/or modified sequence opt4 from anti-influenza_CDR
ggcuucaccuucagcaacgccugg

SEQ ID NO: 37434 - RNA, 24 nt, Artificial Sequence
  derived and/or modified sequence opt4 from anti-influenza_CDR
ggccugagcuuccugaacgccugg

SEQ ID NO: 37435 - RNA, 24 nt, Artificial Sequence
  derived and/or modified sequence opt4 from anti-influenza_CDR
ggcuucagcuuccugaacgccugg

SEQ ID NO: 37436 - RNA, 24 nt, Artificial Sequence
  derived and/or modified sequence opt4 from anti-influenza_CDR
ggccugaccuuccugaacgccugg

SEQ ID NO: 37437 - RNA, 24 nt, Artificial Sequence
  derived and/or modified sequence opt4 from anti-influenza_CDR
ggcuucaccuuccugaacgccugg

SEQ ID NO: 37438 - RNA, 24 nt, Artificial Sequence
  derived and/or modified sequence opt4 from anti-influenza_CDR
ggcuacaccuucaccgacuacuac

SEQ ID NO: 37439 - RNA, 24 nt, Artificial Sequence
  derived and/or modified sequence opt4 from anti-influenza_CDR
gugaaccccuacagcggcggcacc

SEQ ID NO: 37440 - RNA, 24 nt, Artificial Sequence
  derived and/or modified sequence opt4 from anti-influenza_CDR
ggcuacaccuucaccgacuacaac

SEQ ID NO: 37441 - RNA, 24 nt, Artificial Sequence
  derived and/or modified sequence opt4 from anti-influenza_CDR
aucuaccccaacaacggcggcacc

SEQ ID NO: 37442 - RNA, 24 nt, Artificial Sequence
  derived and/or modified sequence opt4 from anti-influenza_CDR
ggcuacaccuucaccggcuacaac

SEQ ID NO: 37443 - RNA, 24 nt, Artificial Sequence
  derived and/or modified sequence opt4 from anti-influenza_CDR
aucuaccccaacaacggcgugacc

SEQ ID NO: 37444 - RNA, 24 nt, Artificial Sequence
  derived and/or modified sequence opt4 from anti-influenza_CDR
auggagaccgacacccugcugcug

SEQ ID NO: 37445 - RNA, 27 nt, Artificial Sequence
  derived and/or modified sequence opt4 from anti-influenza_CDR
gacggcgugaccaacaaggugaacagc

SEQ ID NO: 37446 - RNA, 27 nt, Artificial Sequence
  derived and/or modified sequence opt4 from anti-influenza_CDR
ggcagcgacgugggcagcagcaaccug

SEQ ID NO: 37447 - RNA, 27 nt, Artificial Sequence
  derived and/or modified sequence opt4 from anti-influenza_CDR
augcagaacauccugcugccccugacc

SEQ ID NO: 37448 - RNA, 27 nt, Artificial Sequence
  derived and/or modified sequence opt4 from anti-influenza_CDR
augcagagccugcagcugccccugacc

SEQ ID NO: 37449 - RNA, 27 nt, Artificial Sequence
  derived and/or modified sequence opt4 from anti-influenza_CDR
cagcagcacuacagaaccccccccacc

SEQ ID NO: 37450 - RNA, 27 nt, Artificial Sequence
  derived and/or modified sequence opt4 from anti-influenza_CDR
cagcaguacggcaacagccccuacacc

SEQ ID NO: 37451 - RNA, 27 nt, Artificial Sequence
  derived and/or modified sequence opt4 from anti-influenza_CDR
cagcaguacggcagcagccccuacacc

SEQ ID NO: 37452 - RNA, 27 nt, Artificial Sequence
  derived and/or modified sequence opt4 from anti-influenza_CDR
cagcaguacggcaccagcccccagacc

SEQ ID NO: 37453 - RNA, 27 nt, Artificial Sequence
  derived and/or modified sequence opt4 from anti-influenza_CDR
cagcaguacggcuaccugccccugacc

SEQ ID NO: 37454 - RNA, 27 nt, Artificial Sequence
  derived and/or modified sequence opt4 from anti-influenza_CDR
caggccugggacagcagcaccgccgug

SEQ ID NO: 37455 - RNA, 27 nt, Artificial Sequence
  derived and/or modified sequence opt4 from anti-influenza_CDR
cagcacuacaacgccuacuggggcacc

SEQ ID NO: 37456 - RNA, 27 nt, Artificial Sequence
  derived and/or modified sequence opt4 from anti-influenza_CDR
cagcagaccuacagcagcccccccacc

SEQ ID NO: 37457 - RNA, 27 nt, Artificial Sequence
  derived and/or modified sequence opt4 from anti-influenza_CDR
cagcaguacuacagcuuccccuacacc

SEQ ID NO: 37458 - RNA, 27 nt, Artificial Sequence
  derived and/or modified sequence opt4 from anti-influenza_CDR
augcaggcccugcagcugccccuggcc

SEQ ID NO: 37459 - RNA, 27 nt, Artificial Sequence
  derived and/or modified sequence opt4 from anti-influenza_CDR
cagcaggccaacagcuuccccuucacc

SEQ ID NO: 37460 - RNA, 27 nt, Artificial Sequence
  derived and/or modified sequence opt4 from anti-influenza_CDR
cagcagcugaacggcuacccccugacc

SEQ ID NO: 37461 - RNA, 27 nt, Artificial Sequence
  derived and/or modified sequence opt4 from anti-influenza_CDR
augcaggcccugcagaccccccugacc

SEQ ID NO: 37462 - RNA, 27 nt, Artificial Sequence
  derived and/or modified sequence opt4 from anti-influenza_CDR
cagcagaacuacaacuggccccugacc

SEQ ID NO: 37463 - RNA, 27 nt, Artificial Sequence
  derived and/or modified sequence opt4 from anti-influenza_CDR
cagcaguacgacaccagcagcggccug

SEQ ID NO: 37464 - RNA, 27 nt, Artificial Sequence
  derived and/or modified sequence opt4 from anti-influenza_CDR
cagcaguacaacagcuggcccagaacc

SEQ ID NO: 37465 - RNA, 27 nt, Artificial Sequence
  derived and/or modified sequence opt4 from anti-influenza_CDR
gugaucuacagccacggcagagccuac

SEQ ID NO: 37466 - RNA, 27 nt, Artificial Sequence
  derived and/or modified sequence opt4 from anti-influenza_CDR
cagcaguacggcgacagcagauacacc

SEQ ID NO: 37467 - RNA, 27 nt, Artificial Sequence
  derived and/or modified sequence opt4 from anti-influenza_CDR
cugcagcacaacagcuaccccuacacc

SEQ ID NO: 37468 - RNA, 27 nt, Artificial Sequence
  derived and/or modified sequence opt4 from anti-influenza_CDR
agaaagaugaccaccgccuucgacagc

SEQ ID NO: 37469 - RNA, 27 nt, Artificial Sequence
  derived and/or modified sequence opt4 from anti-influenza_CDR
cagagaaaccacagccccagcuggacc

SEQ ID NO: 37470 - RNA, 27 nt, Artificial Sequence
  derived and/or modified sequence opt4 from anti-influenza_CDR
cagcagagcuacgacaacccccagacc

SEQ ID NO: 37471 - RNA, 27 nt, Artificial Sequence
  derived and/or modified sequence opt4 from anti-influenza_CDR
cagcagagcagaagacugcccuacacc

SEQ ID NO: 37472 - RNA, 27 nt, Artificial Sequence
  derived and/or modified sequence opt4 from anti-influenza_CDR
agaaagaugaccaccgccaucgacuac

SEQ ID NO: 37473 - RNA, 27 nt, Artificial Sequence
  derived and/or modified sequence opt4 from anti-influenza_CDR
aucagauacaccggccagcagcugcug

SEQ ID NO: 37474 - RNA, 27 nt, Artificial Sequence
  derived and/or modified sequence opt4 from anti-influenza_CDR
cagcacuacggcaccaucagccagacc

SEQ ID NO: 37475 - RNA, 27 nt, Artificial Sequence
  derived and/or modified sequence opt4 from anti-influenza_CDR
cagcaguacagcaccagcccccccacc

SEQ ID NO: 37476 - RNA, 27 nt, Artificial Sequence
  derived and/or modified sequence opt4 from anti-influenza_CDR
cagcaguacggcaacagccccaucacc

SEQ ID NO: 37477 - RNA, 27 nt, Artificial Sequence
  derived and/or modified sequence opt4 from anti-influenza_CDR
cagcaguacuacagcagacccuacacc

SEQ ID NO: 37478 - RNA, 27 nt, Artificial Sequence
  derived and/or modified sequence opt4 from anti-influenza_CDR
caggugugggacaacuucggcggcgug

SEQ ID NO: 37479 - RNA, 27 nt, Artificial Sequence
  derived and/or modified sequence opt4 from anti-influenza_CDR
cagcagagcuacagcagcccccugacc

SEQ ID NO: 37480 - RNA, 27 nt, Artificial Sequence
  derived and/or modified sequence opt4 from anti-influenza_CDR
cagcaguacuucgccacccccagaacc

SEQ ID NO: 37481 - RNA, 27 nt, Artificial Sequence
  derived and/or modified sequence opt4 from anti-influenza_CDR
cagcaguacuacuucagcccccugacc

SEQ ID NO: 37482 - RNA, 27 nt, Artificial Sequence
  derived and/or modified sequence opt4 from anti-influenza_CDR
cagcacuucggcaccagcguguucacc

SEQ ID NO: 37483 - RNA, 27 nt, Artificial Sequence
  derived and/or modified sequence opt4 from anti-influenza_CDR
cagcaguacuacaacgccccccugacc

SEQ ID NO: 37484 - RNA, 27 nt, Artificial Sequence
  derived and/or modified sequence opt4 from anti-influenza_CDR
gugcuguucaccagccccuucgacuuc

SEQ ID NO: 37485 - RNA, 27 nt, Artificial Sequence
  derived and/or modified sequence opt4 from anti-influenza_CDR
cugcugagcuacagcggcgugugggug

SEQ ID NO: 37486 - RNA, 27 nt, Artificial Sequence
  derived and/or modified sequence opt4 from anti-influenza_CDR
uuccugagcuacagcggcgccugggug

SEQ ID NO: 37487 - RNA, 27 nt, Artificial Sequence
  derived and/or modified sequence opt4 from anti-influenza_CDR
cagcagagcuucagcaagagcuggacc

SEQ ID NO: 37488 - RNA, 27 nt, Artificial Sequence
  derived and/or modified sequence opt4 from anti-influenza_CDR
gugcaguacgugcaguuccccuggacc

SEQ ID NO: 37489 - RNA, 27 nt, Artificial Sequence
  derived and/or modified sequence opt4 from anti-influenza_CDR
cagcagagcuacagccccccccugacc

SEQ ID NO: 37490 - RNA, 27 nt, Artificial Sequence
  derived and/or modified sequence opt4 from anti-influenza_CDR
uucaucuacuacggcggcaacaccaag

SEQ ID NO: 37491 - RNA, 27 nt, Artificial Sequence
  derived and/or modified sequence opt4 from anti-influenza_CDR
gugaucuacagcggcggcagcaccuac

SEQ ID NO: 37492 - RNA, 27 nt, Artificial Sequence
  derived and/or modified sequence opt4 from anti-influenza_CDR
uucauguuccacagcggcagccccaga

SEQ ID NO: 37493 - RNA, 27 nt, Artificial Sequence
  derived and/or modified sequence opt4 from anti-influenza_CDR
cagcagaccuacagcacccccaucacc

SEQ ID NO: 37494 - RNA, 27 nt, Artificial Sequence
  derived and/or modified sequence opt4 from anti-influenza_CDR
uucuucuacaacggcggcagcaccaag

SEQ ID NO: 37495 - RNA, 27 nt, Artificial Sequence
  derived and/or modified sequence opt4 from anti-influenza_CDR
cagcagagcuacaacaccccccugauc

SEQ ID NO: 37496 - RNA, 27 nt, Artificial Sequence
  derived and/or modified sequence opt4 from anti-influenza_CDR
cacaucuacgacuacggcagaaccuuc

SEQ ID NO: 37497 - RNA, 27 nt, Artificial Sequence
  derived and/or modified sequence opt4 from anti-influenza_CDR
guguucuacagcgagaccagaaccuac

SEQ ID NO: 37498 - RNA, 27 nt, Artificial Sequence
  derived and/or modified sequence opt4 from anti-influenza_CDR
cagguguggggcagcagcagcgaccac

SEQ ID NO: 37499 - RNA, 27 nt, Artificial Sequence
  derived and/or modified sequence opt4 from anti-influenza_CDR
uacguguacaacagaggcagcaccaag

SEQ ID NO: 37500 - RNA, 27 nt, Artificial Sequence
  derived and/or modified sequence opt4 from anti-influenza_CDR
uacaucuacaacagaggcagcaccaag

SEQ ID NO: 37501 - RNA, 27 nt, Artificial Sequence
  derived and/or modified sequence opt4 from anti-influenza_CDR
cagcagagcuacaacacccccaucacc

SEQ ID NO: 37502 - RNA, 27 nt, Artificial Sequence
  derived and/or modified sequence opt4 from anti-influenza_CDR
cagcaguacuacagcagcccccccacc

SEQ ID NO: 37503 - RNA, 27 nt, Artificial Sequence
  derived and/or modified sequence opt4 from anti-influenza_CDR
uaccuguacuacagcggcagcaccaag

SEQ ID NO: 37504 - RNA, 27 nt, Artificial Sequence
  derived and/or modified sequence opt4 from anti-influenza_CDR
cagcagagcuacagcccccccaucacc

SEQ ID NO: 37505 - RNA, 27 nt, Artificial Sequence
  derived and/or modified sequence opt4 from anti-influenza_CDR
uacguguacaacagcggcaacaccaag

SEQ ID NO: 37506 - RNA, 27 nt, Artificial Sequence
  derived and/or modified sequence opt4 from anti-influenza_CDR
cagcagagcuacaacaccccccugacc

SEQ ID NO: 37507 - RNA, 27 nt, Artificial Sequence
  derived and/or modified sequence opt4 from anti-influenza_CDR
cacaucuucgacagcggcagcaccuac

SEQ ID NO: 37508 - RNA, 27 nt, Artificial Sequence
  derived and/or modified sequence opt4 from anti-influenza_CDR
guguucuacagcgccgacagaaccagc

SEQ ID NO: 37509 - RNA, 27 nt, Artificial Sequence
  derived and/or modified sequence opt4 from anti-influenza_CDR
cagcaguacuacagcaccccccugacc

SEQ ID NO: 37510 - RNA, 27 nt, Artificial Sequence
  derived and/or modified sequence opt4 from anti-influenza_CDR
uacaucuacuacagcggcaacaccuac

SEQ ID NO: 37511 - RNA, 27 nt, Artificial Sequence
  derived and/or modified sequence opt4 from anti-influenza_CDR
cagcagagcuacagcaccccccugacc

SEQ ID NO: 37512 - RNA, 27 nt, Artificial Sequence
  derived and/or modified sequence opt4 from anti-influenza_CDR
cagcaguacggcagcagcagccugacc

SEQ ID NO: 37513 - RNA, 27 nt, Artificial Sequence
  derived and/or modified sequence opt4 from anti-influenza_CDR
agcagcuacaccagcagcagcaccuac

SEQ ID NO: 37514 - RNA, 27 nt, Artificial Sequence
  derived and/or modified sequence opt4 from anti-influenza_CDR
cagagauacaacagcgccccccccauc

SEQ ID NO: 37515 - RNA, 27 nt, Artificial Sequence
  derived and/or modified sequence opt4 from anti-influenza_CDR
cagcaguacggcagaaccccccugacc

SEQ ID NO: 37516 - RNA, 27 nt, Artificial Sequence
  derived and/or modified sequence opt4 from anti-influenza_CDR
cagcaguacggcagcagccccagaacc

SEQ ID NO: 37517 - RNA, 27 nt, Artificial Sequence
  derived and/or modified sequence opt4 from anti-influenza_CDR
cagcaguacggcagcagcccccugacc

SEQ ID NO: 37518 - RNA, 27 nt, Artificial Sequence
  derived and/or modified sequence opt4 from anti-influenza_CDR
caggugugggacagcagcagcgaccac

SEQ ID NO: 37519 - RNA, 27 nt, Artificial Sequence
  derived and/or modified sequence opt4 from anti-influenza_CDR
aaggaguucagcgagguggagggcaga

SEQ ID NO: 37520 - RNA, 27 nt, Artificial Sequence
  derived and/or modified sequence opt4 from anti-influenza_CDR
aaggaguucaacaaccuggagaagaga

SEQ ID NO: 37521 - RNA, 27 nt, Artificial Sequence
  derived and/or modified sequence opt4 from anti-influenza_CDR
cagcagcacuacagaaccccccccagc

SEQ ID NO: 37522 - RNA, 27 nt, Artificial Sequence
  derived and/or modified sequence opt4 from anti-influenza_CDR
augcaggccacccacuggccccugacc

SEQ ID NO: 37523 - RNA, 27 nt, Artificial Sequence
  derived and/or modified sequence opt4 from anti-influenza_CDR
cagcaguacuacagcuaccccuacacc

SEQ ID NO: 37524 - RNA, 27 nt, Artificial Sequence
  derived and/or modified sequence opt4 from anti-influenza_CDR
agcagcgacgugggcggcuacaacuac

SEQ ID NO: 37525 - RNA, 27 nt, Artificial Sequence
  derived and/or modified sequence opt4 from anti-influenza_CDR
agcagcgacgugggcgacuacaacuac

SEQ ID NO: 37526 - RNA, 27 nt, Artificial Sequence
  derived and/or modified sequence opt4 from anti-influenza_CDR
cagcaguacaacaacuggccccugagc

SEQ ID NO: 37527 - RNA, 27 nt, Artificial Sequence
  derived and/or modified sequence opt4 from anti-influenza_CDR
cagcagagcuacaacuaccccagaacc

SEQ ID NO: 37528 - RNA, 27 nt, Artificial Sequence
  derived and/or modified sequence opt4 from anti-influenza_CDR
augcagggccugcagacccccuacacc

SEQ ID NO: 37529 - RNA, 27 nt, Artificial Sequence
  derived and/or modified sequence opt4 from anti-influenza_CDR
cagcagcacuacagcaucccccugacc

SEQ ID NO: 37530 - RNA, 27 nt, Artificial Sequence
  derived and/or modified sequence opt4 from anti-influenza_CDR
cugcagcacaacagcuaccccuggacc

SEQ ID NO: 37531 - RNA, 27 nt, Artificial Sequence
  derived and/or modified sequence opt4 from anti-influenza_CDR
cagcaguacaacaccuggccccugacc

SEQ ID NO: 37532 - RNA, 27 nt, Artificial Sequence
  derived and/or modified sequence opt4 from anti-influenza_CDR
cagcaguacaacagcuuccccuacaga

SEQ ID NO: 37533 - RNA, 27 nt, Artificial Sequence
  derived and/or modified sequence opt4 from anti-influenza_CDR
cagcagagcuacagcgcccccuucacc

SEQ ID NO: 37534 - RNA, 27 nt, Artificial Sequence
  derived and/or modified sequence opt4 from anti-influenza_CDR
caggccugggacagcagcaccguggug

SEQ ID NO: 37535 - RNA, 27 nt, Artificial Sequence
  derived and/or modified sequence opt4 from anti-influenza_CDR
caggccugggacagcaccaccguggug

SEQ ID NO: 37536 - RNA, 27 nt, Artificial Sequence
  derived and/or modified sequence opt4 from anti-influenza_CDR
cugcaguacggcagcagccccagaacc

SEQ ID NO: 37537 - RNA, 27 nt, Artificial Sequence
  derived and/or modified sequence opt4 from anti-influenza_CDR
agcagcgacgugggcggcuacgacuac

SEQ ID NO: 37538 - RNA, 27 nt, Artificial Sequence
  derived and/or modified sequence opt4 from anti-influenza_CDR
cagcaguacaccuacuggccccugacc

SEQ ID NO: 37539 - RNA, 27 nt, Artificial Sequence
  derived and/or modified sequence opt4 from anti-influenza_CDR
cagcaguacgacaaguggccccccggc

SEQ ID NO: 37540 - RNA, 27 nt, Artificial Sequence
  derived and/or modified sequence opt4 from anti-influenza_CDR
augcagagccugcagaccagcaucacc

SEQ ID NO: 37541 - RNA, 27 nt, Artificial Sequence
  derived and/or modified sequence opt4 from anti-influenza_CDR
agccagaucgagcuggccgugcugcug

SEQ ID NO: 37542 - RNA, 27 nt, Artificial Sequence
  derived and/or modified sequence opt4 from anti-influenza_CDR
augcaggcccugcagacccccuacacc

SEQ ID NO: 37543 - RNA, 27 nt, Artificial Sequence
  derived and/or modified sequence opt4 from anti-influenza_CDR
cagcagagaagccacuggccccccauc

SEQ ID NO: 37544 - RNA, 27 nt, Artificial Sequence
  derived and/or modified sequence opt4 from anti-influenza_CDR
cagcacuucuggggcaccccccugacc

SEQ ID NO: 37545 - RNA, 27 nt, Artificial Sequence
  derived and/or modified sequence opt4 from anti-influenza_CDR
cagcagaacuacgaggaccccuggacc

SEQ ID NO: 37546 - RNA, 27 nt, Artificial Sequence
  derived and/or modified sequence opt4 from anti-influenza_CDR
cagcaggccaacagcuucccccccacc

SEQ ID NO: 37547 - RNA, 27 nt, Artificial Sequence
  derived and/or modified sequence opt4 from anti-influenza_CDR
cagcagagagaccacuggccccccauc

SEQ ID NO: 37548 - RNA, 27 nt, Artificial Sequence
  derived and/or modified sequence opt4 from anti-influenza_CDR
auggacagcagacugaaccugguguuc

SEQ ID NO: 37549 - RNA, 27 nt, Artificial Sequence
  derived and/or modified sequence opt4 from anti-influenza_CDR
augaagcugcccgugagacugcuggug

SEQ ID NO: 37550 - RNA, 30 nt, Artificial Sequence
  derived and/or modified sequence opt4 from anti-influenza_CDR
ggcgacagcgugaccagaggcggcuucuac

SEQ ID NO: 37551 - RNA, 30 nt, Artificial Sequence; identical to SEQ ID NO: 14625
  derived and/or modified sequence opt4 from anti-influenza_CDR

SEQ ID NO: 37552 - RNA, 30 nt, Artificial Sequence; identical to SEQ ID NO: 14626
  derived and/or modified sequence opt4 from anti-influenza_CDR

SEQ ID NO: 37553 - RNA, 30 nt, Artificial Sequence
  derived and/or modified sequence opt4 from anti-influenza_CDR
agagcccagagccugagcagcuaccugcac

SEQ ID NO: 37554 - RNA, 30 nt, Artificial Sequence
  derived and/or modified sequence opt4 from anti-influenza_CDR
agcagcuacaccagcagcagcaccuacgug

SEQ ID NO: 37555 - RNA, 30 nt, Artificial Sequence
  derived and/or modified sequence opt4 from anti-influenza_CDR
cagagauacaacagcgccccccccaucacc

SEQ ID NO: 37556 - RNA, 30 nt, Artificial Sequence
  derived and/or modified sequence opt4 from anti-influenza_CDR
ggcggcagcaucagcagcggcaccuacuac

SEQ ID NO: 37557 - RNA, 30 nt, Artificial Sequence
  derived and/or modified sequence opt4 from anti-influenza_CDR
cagcagagcuacagcagccugauguucacc

SEQ ID NO: 37558 - RNA, 30 nt, Artificial Sequence
  derived and/or modified sequence opt4 from anti-influenza_CDR
cugcugaucuacggcgccagcaccagagcc

SEQ ID NO: 37559 - RNA, 30 nt, Artificial Sequence
  derived and/or modified sequence opt4 from anti-influenza_CDR
ugcgccuacggcggcaaguaccugguggug

SEQ ID NO: 37560 - RNA, 30 nt, Artificial Sequence
  derived and/or modified sequence opt4 from anti-influenza_CDR
agacccgacuucuacggcgacuucgaguac

SEQ ID NO: 37561 - RNA, 30 nt, Artificial Sequence
  derived and/or modified sequence opt4 from anti-influenza_CDR
cagcacuacggcuacagccccagauacgcc

SEQ ID NO: 37562 - RNA, 30 nt, Artificial Sequence
  derived and/or modified sequence opt4 from anti-influenza_CDR
cagcagagaagccacuggccccccaucacc

SEQ ID NO: 37563 - RNA, 30 nt, Artificial Sequence
  derived and/or modified sequence opt4 from anti-influenza_CDR
agcagcuacgccggcagcagcaccugggug

SEQ ID NO: 37564 - RNA, 30 nt, Artificial Sequence
  derived and/or modified sequence opt4 from anti-influenza_CDR
cugcuguacagcggcggcgaccccguggcc

SEQ ID NO: 37565 - RNA, 30 nt, Artificial Sequence
  derived and/or modified sequence opt4 from anti-influenza_CDR
cagcaguacggcggcagccccagauacacc

SEQ ID NO: 37566 - RNA, 30 nt, Artificial Sequence
  derived and/or modified sequence opt4 from anti-influenza_CDR
agauacggcagcggcuacggcuucgacagc

SEQ ID NO: 37567 - RNA, 30 nt, Artificial Sequence
  derived and/or modified sequence opt4 from anti-influenza_CDR
agcagcuacgccggcaacuacaaccacgug

SEQ ID NO: 37568 - RNA, 30 nt, Artificial Sequence
  derived and/or modified sequence opt4 from anti-influenza_CDR
cagcaguacaucaacuggagaccccugagc

SEQ ID NO: 37569 - RNA, 30 nt, Artificial Sequence
  derived and/or modified sequence opt4 from anti-influenza_CDR
aucggcgccggcuacgacgugcacugguac

SEQ ID NO: 37570 - RNA, 30 nt, Artificial Sequence
  derived and/or modified sequence opt4 from anti-influenza_CDR
cugcugaucuacgacaacaacaacagaccc

SEQ ID NO: 37571 - RNA, 30 nt, Artificial Sequence
  derived and/or modified sequence opt4 from anti-influenza_CDR
cagagcuacgacaacagccugagcggcagc

SEQ ID NO: 37572 - RNA, 30 nt, Artificial Sequence
  derived and/or modified sequence opt4 from anti-influenza_CDR
cugcugaucuacgacgccagcaaccugcag

SEQ ID NO: 37573 - RNA, 30 nt, Artificial Sequence
  derived and/or modified sequence opt4 from anti-influenza_CDR
cugcugauccacgacgccagcaaccuggag

SEQ ID NO: 37574 - RNA, 30 nt, Artificial Sequence
  derived and/or modified sequence opt4 from anti-influenza_CDR
gugcagagacugagcuacggcauggacgug

SEQ ID NO: 37575 - RNA, 30 nt, Artificial Sequence
  derived and/or modified sequence opt4 from anti-influenza_CDR
gugcagaagagcuacuacggcauggacgug

SEQ ID NO: 37576 - RNA, 30 nt, Artificial Sequence
  derived and/or modified sequence opt4 from anti-influenza_CDR
agcagcuacaccagcagcagcacccacgug

SEQ ID NO: 37577 - RNA, 30 nt, Artificial Sequence
  derived and/or modified sequence opt4 from anti-influenza_CDR
agcagcuacaccagcagcagcacccuggug

SEQ ID NO: 37578 - RNA, 30 nt, Artificial Sequence
  derived and/or modified sequence opt4 from anti-influenza_CDR
accaagagaagccagcagaccgugaucccc

SEQ ID NO: 37579 - RNA, 30 nt, Artificial Sequence
  derived and/or modified sequence opt4 from anti-influenza_CDR
accagcagaagccagcagaccgugaucccc

SEQ ID NO: 37580 - RNA, 30 nt, Artificial Sequence
  derived and/or modified sequence opt4 from anti-influenza_CDR
agcagcaacuacaacagaagauucaccccc

SEQ ID NO: 37581 - RNA, 30 nt, Artificial Sequence
  derived and/or modified sequence opt4 from anti-influenza_CDR
agacccaaggugagagaccaggagagcaga

SEQ ID NO: 37582 - RNA, 30 nt, Artificial Sequence
  derived and/or modified sequence opt4 from anti-influenza_CDR
agacccugggugagaggcgugagcagcaga

SEQ ID NO: 37583 - RNA, 30 nt, Artificial Sequence
  derived and/or modified sequence opt4 from anti-influenza_CDR
agacccugggugagaggccugagcagcaga

SEQ ID NO: 37584 - RNA, 30 nt, Artificial Sequence
  derived and/or modified sequence opt4 from anti-influenza_CDR
agacccaaggugagaggccaggccggcaga

SEQ ID NO: 37585 - RNA, 30 nt, Artificial Sequence
  derived and/or modified sequence opt4 from anti-influenza_CDR
gcccccgccguggccgcccaggccagcgcc

SEQ ID NO: 37586 - RNA, 30 nt, Artificial Sequence; identical to SEQ ID NO: 14660
  derived and/or modified sequence opt4 from anti-influenza_CDR

SEQ ID NO: 37587 - RNA, 30 nt, Artificial Sequence
  derived and/or modified sequence opt4 from anti-influenza_CDR
uucggccagggcaccaagguggagaucaag

SEQ ID NO: 37588 - RNA, 30 nt, Artificial Sequence
  derived and/or modified sequence opt4 from anti-influenza_CDR
ggcuucgccuuccacaacagagccaugcac

SEQ ID NO: 37589 - RNA, 30 nt, Artificial Sequence
  derived and/or modified sequence opt4 from anti-influenza_CDR
ggccugaccuucagcagcuacgccgugcac

SEQ ID NO: 37590 - RNA, 30 nt, Artificial Sequence
  derived and/or modified sequence opt4 from anti-influenza_CDR
ggccccaccuucagcagcuacgccgugcac

SEQ ID NO: 37591 - RNA, 30 nt, Artificial Sequence
  derived and/or modified sequence opt4 from anti-influenza_CDR
ggcagcaucuucagcaacuacggcaucagc

SEQ ID NO: 37592 - RNA, 30 nt, Artificial Sequence
  derived and/or modified sequence opt4 from anti-influenza_CDR
ggcuacagcuucaacaacuacggcaucaac

SEQ ID NO: 37593 - RNA, 30 nt, Artificial Sequence; identical to SEQ ID NO: 14667
  derived and/or modified sequence opt4 from anti-influenza_CDR

SEQ ID NO: 37594 - RNA, 30 nt, Artificial Sequence; identical to SEQ ID NO: 14668
  derived and/or modified sequence opt4 from anti-influenza_CDR

SEQ ID NO: 37595 - RNA, 30 nt, Artificial Sequence
  derived and/or modified sequence opt4 from anti-influenza_CDR
agaggcaacuacggcaacggcuucgccuac

SEQ ID NO: 37596 - RNA, 30 nt, Artificial Sequence
  derived and/or modified sequence opt4 from anti-influenza_CDR
cagcaguacggcagcagccccgcccugacc

SEQ ID NO: 37597 - RNA, 30 nt, Artificial Sequence; identical to SEQ ID NO: 14671
  derived and/or modified sequence opt4 from anti-influenza_CDR

SEQ ID NO: 37598 - RNA, 30 nt, Artificial Sequence
  derived and/or modified sequence opt4 from anti-influenza_CDR
aucagaagcggccugaacagauucgagacc

SEQ ID NO: 37599 - RNA, 30 nt, Artificial Sequence
  derived and/or modified sequence opt4 from anti-influenza_CDR
guguucuacagcggcagcagcaacuacaac

SEQ ID NO: 37600 - RNA, 30 nt, Artificial Sequence
  derived and/or modified sequence opt4 from anti-influenza_CDR
ggcgccagcaucagcaccggcggcaacuac

SEQ ID NO: 37601 - RNA, 30 nt, Artificial Sequence; identical to SEQ ID NO: 14675
  derived and/or modified sequence opt4 from anti-influenza_CDR

SEQ ID NO: 37602 - RNA, 30 nt, Artificial Sequence; identical to SEQ ID NO: 14676
  derived and/or modified sequence opt4 from anti-influenza_CDR

SEQ ID NO: 37603 - RNA, 30 nt, Artificial Sequence
  derived and/or modified sequence opt4 from anti-influenza_CDR
cagcagcugaacagcuacccccccaucacc

SEQ ID NO: 37604 - RNA, 30 nt, Artificial Sequence; identical to SEQ ID NO: 14678
  derived and/or modified sequence opt4 from anti-influenza_CDR

SEQ ID NO: 37605 - RNA, 30 nt, Artificial Sequence
  derived and/or modified sequence opt4 from anti-influenza_CDR
cagcagcugaccaccuacccccccaucacc

SEQ ID NO: 37606 - RNA, 30 nt, Artificial Sequence
  derived and/or modified sequence opt4 from anti-influenza_CDR
ggcggcagcaucagcaacggcggcuaccac

SEQ ID NO: 37607 - RNA, 30 nt, Artificial Sequence
  derived and/or modified sequence opt4 from anti-influenza_CDR
ggcgacagcgugaucaacagcgccuacuac

SEQ ID NO: 37608 - RNA, 30 nt, Artificial Sequence; identical to SEQ ID NO: 14682
  derived and/or modified sequence opt4 from anti-influenza_CDR

SEQ ID NO: 37609 - RNA, 30 nt, Artificial Sequence
  derived and/or modified sequence opt4 from anti-influenza_CDR
gccggcgacuacagcggcggcaucuacgcc

SEQ ID NO: 37610 - RNA, 30 nt, Artificial Sequence
  derived and/or modified sequence opt4 from anti-influenza_CDR
gccggcgacuacagcggcagcaacuacgcc

SEQ ID NO: 37611 - RNA, 30 nt, Artificial Sequence
  derived and/or modified sequence opt4 from anti-influenza_CDR
gccggcgacuacagcggcgccaacuacgcc

SEQ ID NO: 37612 - RNA, 30 nt, Artificial Sequence
  derived and/or modified sequence opt4 from anti-influenza_CDR
ggccugagccuguacagcaacgagaucaac

SEQ ID NO: 37613 - RNA, 30 nt, Artificial Sequence; identical to SEQ ID NO: 14687
  derived and/or modified sequence opt4 from anti-influenza_CDR

SEQ ID NO: 37614 - RNA, 30 nt, Artificial Sequence
  derived and/or modified sequence opt4 from anti-influenza_CDR
gccagccagagcgugagcaccuuccuggcc

SEQ ID NO: 37615 - RNA, 30 nt, Artificial Sequence
  derived and/or modified sequence opt4 from anti-influenza_CDR
aucaagagcaacaccgacggcggcaccacc

SEQ ID NO: 37616 - RNA, 30 nt, Artificial Sequence
  derived and/or modified sequence opt4 from anti-influenza_CDR
gagagcguggacaucuacggcaacagcuuc

SEQ ID NO: 37617 - RNA, 30 nt, Artificial Sequence
  derived and/or modified sequence opt4 from anti-influenza_CDR
gagagcaucgacaucuacggcaacagcuuc

SEQ ID NO: 37618 - RNA, 30 nt, Artificial Sequence
  derived and/or modified sequence opt4 from anti-influenza_CDR
gccggcgacuacagcggcgugaacuacgcc

SEQ ID NO: 37619 - RNA, 33 nt, Artificial Sequence
  derived and/or modified sequence opt4 from anti-influenza_CDR
gccgccugggacgacagccugaacggccagcug

SEQ ID NO: 37620 - RNA, 33 nt, Artificial Sequence
  derived and/or modified sequence opt4 from anti-influenza_CDR
ugcagcuacgccggcagcagcagcagcagagug

SEQ ID NO: 37621 - RNA, 33 nt, Artificial Sequence
  derived and/or modified sequence opt4 from anti-influenza_CDR
cuggugcuggccaccggccugagaaacagcccc

SEQ ID NO: 37622 - RNA, 33 nt, Artificial Sequence
  derived and/or modified sequence opt4 from anti-influenza_CDR
cagagccugcugcacagcgacggcaagaccuac

SEQ ID NO: 37623 - RNA, 33 nt, Artificial Sequence
  derived and/or modified sequence opt4 from anti-influenza_CDR
agaaccagccagagccugagcagcuaccugcac

SEQ ID NO: 37624 - RNA, 33 nt, Artificial Sequence
  derived and/or modified sequence opt4 from anti-influenza_CDR
agagccagccagagacugaacagcuaccugcac

SEQ ID NO: 37625 - RNA, 33 nt, Artificial Sequence
  derived and/or modified sequence opt4 from anti-influenza_CDR
agaaccagccagagccugagaagcuaccugcac

SEQ ID NO: 37626 - RNA, 33 nt, Artificial Sequence
  derived and/or modified sequence opt4 from anti-influenza_CDR
agaaccagccagagccugagcagcuacacccac

SEQ ID NO: 37627 - RNA, 33 nt, Artificial Sequence
  derived and/or modified sequence opt4 from anti-influenza_CDR
agaaccagccagagccugagcagcuacgaccac

SEQ ID NO: 37628 - RNA, 33 nt, Artificial Sequence
  derived and/or modified sequence opt4 from anti-influenza_CDR
caggugugggacagcagcagcgaccacuacgug

SEQ ID NO: 37629 - RNA, 33 nt, Artificial Sequence
  derived and/or modified sequence opt4 from anti-influenza_CDR
cagguguggggcagcagcagcgaccacuacgug

SEQ ID NO: 37630 - RNA, 33 nt, Artificial Sequence
  derived and/or modified sequence opt4 from anti-influenza_CDR
ggcaccugggacagcagccugagcgugggcaug

SEQ ID NO: 37631 - RNA, 33 nt, Artificial Sequence
  derived and/or modified sequence opt4 from anti-influenza_CDR
cagagccugcugcacggcaacggcuacaacuac

SEQ ID NO: 37632 - RNA, 33 nt, Artificial Sequence
  derived and/or modified sequence opt4 from anti-influenza_CDR
agagccagccagggcaucagaaacgaccugggc

SEQ ID NO: 37633 - RNA, 33 nt, Artificial Sequence
  derived and/or modified sequence opt4 from anti-influenza_CDR
agagccagccagaacaucagaagcuaccugaac

SEQ ID NO: 37634 - RNA, 33 nt, Artificial Sequence
  derived and/or modified sequence opt4 from anti-influenza_CDR
agagccaaccaggacaucggcaucuaccugaac

SEQ ID NO: 37635 - RNA, 33 nt, Artificial Sequence
  derived and/or modified sequence opt4 from anti-influenza_CDR
agagccagccagagcgugagcaacaaccuggcc

SEQ ID NO: 37636 - RNA, 33 nt, Artificial Sequence
  derived and/or modified sequence opt4 from anti-influenza_CDR
cagcaguaccacaacuggccccccagcuacagc

SEQ ID NO: 37637 - RNA, 33 nt, Artificial Sequence
  derived and/or modified sequence opt4 from anti-influenza_CDR
agagccagccagggcauccugaacugccuggcc

SEQ ID NO: 37638 - RNA, 33 nt, Artificial Sequence
  derived and/or modified sequence opt4 from anti-influenza_CDR
agagccagccagagcaucgccagcuggcuggcc

SEQ ID NO: 37639 - RNA, 33 nt, Artificial Sequence
  derived and/or modified sequence opt4 from anti-influenza_CDR
gcccccagaguguacgaguacuacuucgaccag

SEQ ID NO: 37640 - RNA, 33 nt, Artificial Sequence
  derived and/or modified sequence opt4 from anti-influenza_CDR
agagccagccagagcgugagcagcuaccuggcc

SEQ ID NO: 37641 - RNA, 33 nt, Artificial Sequence; identical to SEQ ID NO: 14715
  derived and/or modified sequence opt4 from anti-influenza_CDR

SEQ ID NO: 37642 - RNA, 33 nt, Artificial Sequence
  derived and/or modified sequence opt4 from anti-influenza_CDR
cagagcgccgacagcagcggcaccagcugggug

SEQ ID NO: 37643 - RNA, 33 nt, Artificial Sequence
  derived and/or modified sequence opt4 from anti-influenza_CDR
ggcggcagcaacaucggcggcaagagcgugcac

SEQ ID NO: 37644 - RNA, 33 nt, Artificial Sequence
  derived and/or modified sequence opt4 from anti-influenza_CDR
cagcacuacggcagcagccccagauacgccuuc

SEQ ID NO: 37645 - RNA, 33 nt, Artificial Sequence
  derived and/or modified sequence opt4 from anti-influenza_CDR
agagccagccagagcaucagcagcuaccugaac

SEQ ID NO: 37646 - RNA, 33 nt, Artificial Sequence
  derived and/or modified sequence opt4 from anti-influenza_CDR
ggcggcaacgccaucggcagcaagaaggugcac

SEQ ID NO: 37647 - RNA, 33 nt, Artificial Sequence
  derived and/or modified sequence opt4 from anti-influenza_CDR
caggugugggacuucaccaucgaccacguggug

SEQ ID NO: 37648 - RNA, 33 nt, Artificial Sequence
  derived and/or modified sequence opt4 from anti-influenza_CDR
gccaccugggacggcagccugagcgccugggug

SEQ ID NO: 37649 - RNA, 33 nt, Artificial Sequence
  derived and/or modified sequence opt4 from anti-influenza_CDR
agagccagccagagcgugggcaacuaccuggcc

SEQ ID NO: 37650 - RNA, 33 nt, Artificial Sequence
  derived and/or modified sequence opt4 from anti-influenza_CDR
cagcagagaagcaaguggccccccauguacagc

SEQ ID NO: 37651 - RNA, 33 nt, Artificial Sequence
  derived and/or modified sequence opt4 from anti-influenza_CDR
gacgugagcaccaccuggagcugguucgccccc

SEQ ID NO: 37652 - RNA, 33 nt, Artificial Sequence
  derived and/or modified sequence opt4 from anti-influenza_CDR
agagccagccagaacaucaagagauacuucaac

SEQ ID NO: 37653 - RNA, 33 nt, Artificial Sequence
  derived and/or modified sequence opt4 from anti-influenza_CDR
agagccagccagagcgugggcaacagccuggcc

SEQ ID NO: 37654 - RNA, 33 nt, Artificial Sequence
  derived and/or modified sequence opt4 from anti-influenza_CDR
ggcgagagcacccugagcuacuacgccgugagc

SEQ ID NO: 37655 - RNA, 33 nt, Artificial Sequence
  derived and/or modified sequence opt4 from anti-influenza_CDR
agagccagccagaacaucuacaaguaccugaac

SEQ ID NO: 37656 - RNA, 33 nt, Artificial Sequence
  derived and/or modified sequence opt4 from anti-influenza_CDR
gccagcugcagcggcggcuacugcauccuggac

SEQ ID NO: 37657 - RNA, 33 nt, Artificial Sequence
  derived and/or modified sequence opt4 from anti-influenza_CDR
agaaccagccagagcaucagcagcuaccugaac

SEQ ID NO: 37658 - RNA, 33 nt, Artificial Sequence
  derived and/or modified sequence opt4 from anti-influenza_CDR
agagccagccagagcaucggcgccuacgugaac

SEQ ID NO: 37659 - RNA, 33 nt, Artificial Sequence
  derived and/or modified sequence opt4 from anti-influenza_CDR
agagccagccagagcaucagcaccuaccugaac

SEQ ID NO: 37660 - RNA, 33 nt, Artificial Sequence
  derived and/or modified sequence opt4 from anti-influenza_CDR
agagccagccagagcaucgacaaguuccugaac

SEQ ID NO: 37661 - RNA, 33 nt, Artificial Sequence
  derived and/or modified sequence opt4 from anti-influenza_CDR
ggcggccacaacaucggcagcaacagcgugcac

SEQ ID NO: 37662 - RNA, 33 nt, Artificial Sequence
  derived and/or modified sequence opt4 from anti-influenza_CDR
agagccagccagagcaucagcaccuaccugcac

SEQ ID NO: 37663 - RNA, 33 nt, Artificial Sequence
  derived and/or modified sequence opt4 from anti-influenza_CDR
cacgugggcggccacaccuacggcaucgacuac

SEQ ID NO: 37664 - RNA, 33 nt, Artificial Sequence
  derived and/or modified sequence opt4 from anti-influenza_CDR
agagccagccagagcaucagcaacuaccugaac

SEQ ID NO: 37665 - RNA, 33 nt, Artificial Sequence
  derived and/or modified sequence opt4 from anti-influenza_CDR
cacgacgacgccagccacggcuacagcaucagc

SEQ ID NO: 37666 - RNA, 33 nt, Artificial Sequence
  derived and/or modified sequence opt4 from anti-influenza_CDR
agagccagccagaccaucagcaccuaccugaac

SEQ ID NO: 37667 - RNA, 33 nt, Artificial Sequence
  derived and/or modified sequence opt4 from anti-influenza_CDR
agagccagccagagcaucagcagauaccugaac

SEQ ID NO: 37668 - RNA, 33 nt, Artificial Sequence
  derived and/or modified sequence opt4 from anti-influenza_CDR
ggcaccugggacagcagccugagcgccuacgug

SEQ ID NO: 37669 - RNA, 33 nt, Artificial Sequence
  derived and/or modified sequence opt4 from anti-influenza_CDR
agcagcaacuacuacgacagcguguacgacuac

SEQ ID NO: 37670 - RNA, 33 nt, Artificial Sequence
  derived and/or modified sequence opt4 from anti-influenza_CDR
gccgccugggacgacauccugaacgugcccgug

SEQ ID NO: 37671 - RNA, 33 nt, Artificial Sequence
  derived and/or modified sequence opt4 from anti-influenza_CDR
guggccugggacgacagcguggacggcuacgug

SEQ ID NO: 37672 - RNA, 33 nt, Artificial Sequence; identical to SEQ ID NO: 14746
  derived and/or modified sequence opt4 from anti-influenza_CDR

SEQ ID NO: 37673 - RNA, 33 nt, Artificial Sequence
  derived and/or modified sequence opt4 from anti-influenza_CDR
agagccagccagggcaucagcagcuaccuggcc

SEQ ID NO: 37674 - RNA, 33 nt, Artificial Sequence
  derived and/or modified sequence opt4 from anti-influenza_CDR
agcagcggcuacuaccccgaguacuuccaggac

SEQ ID NO: 37675 - RNA, 33 nt, Artificial Sequence
  derived and/or modified sequence opt4 from anti-influenza_CDR
agcggccacaagcugggcgacaaguacgugagc

SEQ ID NO: 37676 - RNA, 33 nt, Artificial Sequence; identical to SEQ ID NO: 14750
  derived and/or modified sequence opt4 from anti-influenza_CDR

SEQ ID NO: 37677 - RNA, 33 nt, Artificial Sequence
  derived and/or modified sequence opt4 from anti-influenza_CDR
agagccagccagagagugagcagcuaccuggcc

SEQ ID NO: 37678 - RNA, 33 nt, Artificial Sequence; identical to SEQ ID NO: 36571
  derived and/or modified sequence opt4 from anti-influenza_CDR

SEQ ID NO: 37679 - RNA, 33 nt, Artificial Sequence
  derived and/or modified sequence opt4 from anti-influenza_CDR
caggugugggacagcagcagcgaccacgccgug

SEQ ID NO: 37680 - RNA, 33 nt, Artificial Sequence; identical to SEQ ID NO: 14754
  derived and/or modified sequence opt4 from anti-influenza_CDR

SEQ ID NO: 37681 - RNA, 33 nt, Artificial Sequence
  derived and/or modified sequence opt4 from anti-influenza_CDR
agcagcggcuacuaccccgccuaccugccccac

SEQ ID NO: 37682 - RNA, 33 nt, Artificial Sequence
  derived and/or modified sequence opt4 from anti-influenza_CDR
ggcggcaacaacaucggcagcaagggcgugcac

SEQ ID NO: 37683 - RNA, 33 nt, Artificial Sequence
  derived and/or modified sequence opt4 from anti-influenza_CDR
caggugugggacagcagcagcgaccacguggug

SEQ ID NO: 37684 - RNA, 33 nt, Artificial Sequence
  derived and/or modified sequence opt4 from anti-influenza_CDR
ggcaacuacuacuacgagagcagccuggacuac

SEQ ID NO: 37685 - RNA, 33 nt, Artificial Sequence
  derived and/or modified sequence opt4 from anti-influenza_CDR
ggcccccacuacuacagcagcuacauggacgug

SEQ ID NO: 37686 - RNA, 33 nt, Artificial Sequence
  derived and/or modified sequence opt4 from anti-influenza_CDR
agagccagccagggcaucagcaccuaccuggcc

SEQ ID NO: 37687 - RNA, 33 nt, Artificial Sequence; identical to SEQ ID NO: 14761
  derived and/or modified sequence opt4 from anti-influenza_CDR

SEQ ID NO: 37688 - RNA, 33 nt, Artificial Sequence
  derived and/or modified sequence opt4 from anti-influenza_CDR
ggcggcaacaacaucggcagaaacagcgugcac

SEQ ID NO: 37689 - RNA, 33 nt, Artificial Sequence
  derived and/or modified sequence opt4 from anti-influenza_CDR
cagguguggcacagcagcagcgaccacuacgug

SEQ ID NO: 37690 - RNA, 33 nt, Artificial Sequence
  derived and/or modified sequence opt4 from anti-influenza_CDR
agcagcggcuacuacccccaguacuuccaggac

SEQ ID NO: 37691 - RNA, 33 nt, Artificial Sequence
  derived and/or modified sequence opt4 from anti-influenza_CDR
agagccagccagagcgugagcagauaccuggcc

SEQ ID NO: 37692 - RNA, 33 nt, Artificial Sequence
  derived and/or modified sequence opt4 from anti-influenza_CDR
uggggccagggcaccacccugaccgugagcagc

SEQ ID NO: 37693 - RNA, 33 nt, Artificial Sequence
  derived and/or modified sequence opt4 from anti-influenza_CDR
agagccagccagagcguggacagcaaccuggcc

SEQ ID NO: 37694 - RNA, 33 nt, Artificial Sequence
  derived and/or modified sequence opt4 from anti-influenza_CDR
agagccagccagagcgugagccacaaccuggcc

SEQ ID NO: 37695 - RNA, 33 nt, Artificial Sequence
  derived and/or modified sequence opt4 from anti-influenza_CDR
agagccagccagagcgugagcagcaaccuggcc

SEQ ID NO: 37696 - RNA, 33 nt, Artificial Sequence
  derived and/or modified sequence opt4 from anti-influenza_CDR
agagccagccagagcguggaccacaaccuggcc

SEQ ID NO: 37697 - RNA, 33 nt, Artificial Sequence
  derived and/or modified sequence opt4 from anti-influenza_CDR
cagcacuacaccaacuggccccccagacugacc

SEQ ID NO: 37698 - RNA, 33 nt, Artificial Sequence
  derived and/or modified sequence opt4 from anti-influenza_CDR
cagcacuacaccaacuacccccccagacugacc

SEQ ID NO: 37699 - RNA, 33 nt, Artificial Sequence
  derived and/or modified sequence opt4 from anti-influenza_CDR
cagcacuacaccaacuucccccccagacugacc

SEQ ID NO: 37700 - RNA, 33 nt, Artificial Sequence
  derived and/or modified sequence opt4 from anti-influenza_CDR
agagccagccaggugaucagccacaaccuggcc

SEQ ID NO: 37701 - RNA, 33 nt, Artificial Sequence
  derived and/or modified sequence opt4 from anti-influenza_CDR
cagcacuacagcaacuggccccccagacugacc

SEQ ID NO: 37702 - RNA, 33 nt, Artificial Sequence
  derived and/or modified sequence opt4 from anti-influenza_CDR
cagcacuacagcaacuucccccccagacugacc

SEQ ID NO: 37703 - RNA, 33 nt, Artificial Sequence
  derived and/or modified sequence opt4 from anti-influenza_CDR
cagcacuacagcaacuacccccccagacugacc

SEQ ID NO: 37704 - RNA, 33 nt, Artificial Sequence
  derived and/or modified sequence opt4 from anti-influenza_CDR
agagccagccagagcguggccaacaaccuggcc

SEQ ID NO: 37705 - RNA, 33 nt, Artificial Sequence; identical to SEQ ID NO: 22421
  derived and/or modified sequence opt4 from anti-influenza_CDR

SEQ ID NO: 37706 - RNA, 33 nt, Artificial Sequence
  derived and/or modified sequence opt4 from anti-influenza_CDR
agagccagccagagcaucggcaacuggcuggcc

SEQ ID NO: 37707 - RNA, 33 nt, Artificial Sequence
  derived and/or modified sequence opt4 from anti-influenza_CDR
cagagauacaccagcaacagccagggcuucacc

SEQ ID NO: 37708 - RNA, 33 nt, Artificial Sequence; identical to SEQ ID NO: 14782
  derived and/or modified sequence opt4 from anti-influenza_CDR

SEQ ID NO: 37709 - RNA, 33 nt, Artificial Sequence
  derived and/or modified sequence opt4 from anti-influenza_CDR
aaggccagccagaacgugggcagcaacguggcc

SEQ ID NO: 37710 - RNA, 33 nt, Artificial Sequence
  derived and/or modified sequence opt4 from anti-influenza_CDR
caggugugggacaugagcagcgacagaagagug

SEQ ID NO: 37711 - RNA, 33 nt, Artificial Sequence
  derived and/or modified sequence opt4 from anti-influenza_CDR
cagagccugcugcacagcaacggcuacaacuac

SEQ ID NO: 37712 - RNA, 33 nt, Artificial Sequence
  derived and/or modified sequence opt4 from anti-influenza_CDR
accuaccuggugggcgccgugggcuuccagcac

SEQ ID NO: 37713 - RNA, 33 nt, Artificial Sequence; identical to SEQ ID NO: 13698
  derived and/or modified sequence opt4 from anti-influenza_CDR

SEQ ID NO: 37714 - RNA, 33 nt, Artificial Sequence
  derived and/or modified sequence opt4 from anti-influenza_CDR
cagagccugcuggacagcaacggcuacaacuac

SEQ ID NO: 37715 - RNA, 33 nt, Artificial Sequence
  derived and/or modified sequence opt4 from anti-influenza_CDR
augcaggcccugcagaccccccccauguacacc

SEQ ID NO: 37716 - RNA, 33 nt, Artificial Sequence
  derived and/or modified sequence opt4 from anti-influenza_CDR
cagagccugcugcacagcaacggcuacaaccac

SEQ ID NO: 37717 - RNA, 33 nt, Artificial Sequence
  derived and/or modified sequence opt4 from anti-influenza_CDR
caggugugggacaucaccagcgaccugguggug

SEQ ID NO: 37718 - RNA, 33 nt, Artificial Sequence
  derived and/or modified sequence opt4 from anti-influenza_CDR
agagccagccaggacaucagcaccuggcuggcc

SEQ ID NO: 37719 - RNA, 33 nt, Artificial Sequence
  derived and/or modified sequence opt4 from anti-influenza_CDR
agagccagcagaagcaucaccaccuuccuggcc

SEQ ID NO: 37720 - RNA, 33 nt, Artificial Sequence
  derived and/or modified sequence opt4 from anti-influenza_CDR
ggcuggggcgccgugaccagccccuucgacuuc

SEQ ID NO: 37721 - RNA, 33 nt, Artificial Sequence
  derived and/or modified sequence opt4 from anti-influenza_CDR
agagccagccagagcgugagcagcagcuaccug

SEQ ID NO: 37722 - RNA, 36 nt, Artificial Sequence
  derived and/or modified sequence opt4 from anti-influenza_CDR
cagagcgugcuguacagcagcaacaacaagaacuac

SEQ ID NO: 37723 - RNA, 36 nt, Artificial Sequence
  derived and/or modified sequence opt4 from anti-influenza_CDR
gccgccugggacgacagccugagcggcagcugggug

SEQ ID NO: 37724 - RNA, 36 nt, Artificial Sequence
  derived and/or modified sequence opt4 from anti-influenza_CDR
guguucuacagcgccgacagaaccagcuacgccgac

SEQ ID NO: 37725 - RNA, 36 nt, Artificial Sequence
  derived and/or modified sequence opt4 from anti-influenza_CDR
agagugggccagagcgugagcggcagccaccuggcc

SEQ ID NO: 37726 - RNA, 36 nt, Artificial Sequence
  derived and/or modified sequence opt4 from anti-influenza_CDR
acccugagcagcgccuacagcaacuacaagguggac

SEQ ID NO: 37727 - RNA, 36 nt, Artificial Sequence
  derived and/or modified sequence opt4 from anti-influenza_CDR
gugggcaccggcggcaucgugggcagcaagggcgac

SEQ ID NO: 37728 - RNA, 36 nt, Artificial Sequence
  derived and/or modified sequence opt4 from anti-influenza_CDR
agauacagcagaagcagccccggcaccuucgagagc

SEQ ID NO: 37729 - RNA, 36 nt, Artificial Sequence
  derived and/or modified sequence opt4 from anti-influenza_CDR
cagagcuacgacagcagccugagcggcuuccacgug

SEQ ID NO: 37730 - RNA, 36 nt, Artificial Sequence
  derived and/or modified sequence opt4 from anti-influenza_CDR
agagccagccagagcgugagcagcagccagcuggcc

SEQ ID NO: 37731 - RNA, 36 nt, Artificial Sequence
  derived and/or modified sequence opt4 from anti-influenza_CDR
agagccagccaguucgugagcaccagaagccuggcc

SEQ ID NO: 37732 - RNA, 36 nt, Artificial Sequence; identical to SEQ ID NO: 14806
  derived and/or modified sequence opt4 from anti-influenza_CDR

SEQ ID NO: 37733 - RNA, 36 nt, Artificial Sequence
  derived and/or modified sequence opt4 from anti-influenza_CDR
agagccagccacuucgugaacuacagaagccuggcc

SEQ ID NO: 37734 - RNA, 36 nt, Artificial Sequence
  derived and/or modified sequence opt4 from anti-influenza_CDR
agagccagccacuucgugaucggcagagccguggcc

SEQ ID NO: 37735 - RNA, 36 nt, Artificial Sequence
  derived and/or modified sequence opt4 from anti-influenza_CDR
agaaucuaccacggcggcaacagcggcuucgacuuc

SEQ ID NO: 37736 - RNA, 36 nt, Artificial Sequence
  derived and/or modified sequence opt4 from anti-influenza_CDR
acccugagcagcggcuucgacaacuaccagguggcc

SEQ ID NO: 37737 - RNA, 36 nt, Artificial Sequence
  derived and/or modified sequence opt4 from anti-influenza_CDR
gugggcaacggcggcaacguggccagcaagggcgac

SEQ ID NO: 37738 - RNA, 36 nt, Artificial Sequence
  derived and/or modified sequence opt4 from anti-influenza_CDR
gugagaggcggcagcaccguggccuacuucggcgug

SEQ ID NO: 37739 - RNA, 36 nt, Artificial Sequence
  derived and/or modified sequence opt4 from anti-influenza_CDR
ugccugagcagaaugagaggcuacggccuggacgug

SEQ ID NO: 37740 - RNA, 36 nt, Artificial Sequence
  derived and/or modified sequence opt4 from anti-influenza_CDR
gugggccagauggacaaguacuacgccauggacgug

SEQ ID NO: 37741 - RNA, 36 nt, Artificial Sequence
  derived and/or modified sequence opt4 from anti-influenza_CDR
ggcgugaccaacaaggugaacagcaucaucgacaag

SEQ ID NO: 37742 - RNA, 36 nt, Artificial Sequence
  derived and/or modified sequence opt4 from anti-influenza_CDR
ggcgugaccaacaaggugaacagaaucaucgacaag

SEQ ID NO: 37743 - RNA, 36 nt, Artificial Sequence; identical to SEQ ID NO: 14817
  derived and/or modified sequence opt4 from anti-influenza_CDR

SEQ ID NO: 37744 - RNA, 36 nt, Artificial Sequence
  derived and/or modified sequence opt4 from anti-influenza_CDR
ccccugggcauccugcacuacuacgccauggaccug

SEQ ID NO: 37745 - RNA, 36 nt, Artificial Sequence
  derived and/or modified sequence opt4 from anti-influenza_CDR
aagaucaccagcaaggugaacaacaucguggacaag

SEQ ID NO: 37746 - RNA, 36 nt, Artificial Sequence; identical to SEQ ID NO: 14820
  derived and/or modified sequence opt4 from anti-influenza_CDR

SEQ ID NO: 37747 - RNA, 36 nt, Artificial Sequence
  derived and/or modified sequence opt4 from anti-influenza_CDR
aacggcagaagcagcaccagcuggggcaucgacgug

SEQ ID NO: 37748 - RNA, 36 nt, Artificial Sequence; identical to SEQ ID NO: 14822
  derived and/or modified sequence opt4 from anti-influenza_CDR

SEQ ID NO: 37749 - RNA, 36 nt, Artificial Sequence
  derived and/or modified sequence opt4 from anti-influenza_CDR
ccccugggcagcagauacuacuacggcauggacgug

SEQ ID NO: 37750 - RNA, 36 nt, Artificial Sequence
  derived and/or modified sequence opt4 from anti-influenza_CDR
ggcaucaccaacaaggugaacagcgugaucgagaag

SEQ ID NO: 37751 - RNA, 36 nt, Artificial Sequence
  derived and/or modified sequence opt4 from anti-influenza_CDR
ggcgugaccaacaaggugaacagcaucaucaacaag

SEQ ID NO: 37752 - RNA, 36 nt, Artificial Sequence
  derived and/or modified sequence opt4 from anti-influenza_CDR
cacaugggcuaccaggugagagagaccauggacgug

SEQ ID NO: 37753 - RNA, 36 nt, Artificial Sequence
  derived and/or modified sequence opt4 from anti-influenza_CDR
gccaccugggacagaagacccaccgccuacguggug

SEQ ID NO: 37754 - RNA, 36 nt, Artificial Sequence; identical to SEQ ID NO: 22470
  derived and/or modified sequence opt4 from anti-influenza_CDR

SEQ ID NO: 37755 - RNA, 36 nt, Artificial Sequence
  derived and/or modified sequence opt4 from anti-influenza_CDR
ggcgacaagggcaucuacuacuacuacauggacgug

SEQ ID NO: 37756 - RNA, 36 nt, Artificial Sequence
  derived and/or modified sequence opt4 from anti-influenza_CDR
ggcagcggcuaccacaucagcacccccuucgacaac

SEQ ID NO: 37757 - RNA, 36 nt, Artificial Sequence
  derived and/or modified sequence opt4 from anti-influenza_CDR
agagccagccagagcgugagcagcagcuaccuggcc

SEQ ID NO: 37758 - RNA, 36 nt, Artificial Sequence
  derived and/or modified sequence opt4 from anti-influenza_CDR
ggcagcggcuacaccaccagaaacuacuucgacuac

SEQ ID NO: 37759 - RNA, 36 nt, Artificial Sequence
  derived and/or modified sequence opt4 from anti-influenza_CDR
agagccagccagagcgugagcagcaacuaccugggc

SEQ ID NO: 37760 - RNA, 36 nt, Artificial Sequence
  derived and/or modified sequence opt4 from anti-influenza_CDR
ggcagcaccuacgacuucagcagcggccuggacuac

SEQ ID NO: 37761 - RNA, 36 nt, Artificial Sequence
  derived and/or modified sequence opt4 from anti-influenza_CDR
ggcgugcaccaccccggcaccgacaacgaccagauc

SEQ ID NO: 37762 - RNA, 36 nt, Artificial Sequence
  derived and/or modified sequence opt4 from anti-influenza_CDR
ggcgugcaccaccccagcaccgacagcgaccagacc

SEQ ID NO: 37763 - RNA, 36 nt, Artificial Sequence
  derived and/or modified sequence opt4 from anti-influenza_CDR
ggcgugcaccaccccagcaacgagaccgagcagaga

SEQ ID NO: 37764 - RNA, 36 nt, Artificial Sequence; identical to SEQ ID NO: 14838
  derived and/or modified sequence opt4 from anti-influenza_CDR

SEQ ID NO: 37765 - RNA, 36 nt, Artificial Sequence
  derived and/or modified sequence opt4 from anti-influenza_CDR
ggcggccugaucggcaccggcagcuacuacuggggc

SEQ ID NO: 37766 - RNA, 36 nt, Artificial Sequence
  derived and/or modified sequence opt4 from anti-influenza_CDR
gccagauacaacuggggcaucagauacuucgacuuc

SEQ ID NO: 37767 - RNA, 36 nt, Artificial Sequence
  derived and/or modified sequence opt4 from anti-influenza_CDR
cagagcgugcugagcaacagcaagaaccugaacuac

SEQ ID NO: 37768 - RNA, 36 nt, Artificial Sequence
  derived and/or modified sequence opt4 from anti-influenza_CDR
ugccaggugugggagaccagcgaggaccugugggug

SEQ ID NO: 37769 - RNA, 39 nt, Artificial Sequence
  derived and/or modified sequence opt4 from anti-influenza_CDR
gccagaggcggcagauacuacguggacuacuucgacuac

SEQ ID NO: 37770 - RNA, 39 nt, Artificial Sequence
  derived and/or modified sequence opt4 from anti-influenza_CDR
gccagaagcggcgacggcuacaacuacuacuucccccug

SEQ ID NO: 37771 - RNA, 39 nt, Artificial Sequence
  derived and/or modified sequence opt4 from anti-influenza_CDR
gccagaggcugcggcuacaacugcuacuacuucgacggc

SEQ ID NO: 37772 - RNA, 39 nt, Artificial Sequence
  derived and/or modified sequence opt4 from anti-influenza_CDR
agcggcagcagcagcaacaucggcagcaacaccgugaac

SEQ ID NO: 37773 - RNA, 39 nt, Artificial Sequence
  derived and/or modified sequence opt4 from anti-influenza_CDR
gacagccccuacagcagcagcuggagcuucuucgacuac

SEQ ID NO: 37774 - RNA, 39 nt, Artificial Sequence
  derived and/or modified sequence opt4 from anti-influenza_CDR
agcggcagcgacagcaacaucggcgacuacuucgugugc

SEQ ID NO: 37775 - RNA, 39 nt, Artificial Sequence
  derived and/or modified sequence opt4 from anti-influenza_CDR
gccagaauggugguggugaccggcgacggcuucgacgug

SEQ ID NO: 37776 - RNA, 39 nt, Artificial Sequence
  derived and/or modified sequence opt4 from anti-influenza_CDR
uggcugagcaucaucaacgccggcggcggcgacaucgac

SEQ ID NO: 37777 - RNA, 39 nt, Artificial Sequence
  derived and/or modified sequence opt4 from anti-influenza_CDR
gccgccagcagccugcagagcggcgugcccagcagauuc

SEQ ID NO: 37778 - RNA, 39 nt, Artificial Sequence
  derived and/or modified sequence opt4 from anti-influenza_CDR
cacgacgccaaguucagcggcagcuacuacguggccagc

SEQ ID NO: 37779 - RNA, 39 nt, Artificial Sequence
  derived and/or modified sequence opt4 from anti-influenza_CDR
cacgacgugaaguucagcggcagcuacuacguggccagc

SEQ ID NO: 37780 - RNA, 39 nt, Artificial Sequence
  derived and/or modified sequence opt4 from anti-influenza_CDR
accggcagcgagagcaccaccggcuacggcauggacgug

SEQ ID NO: 37781 - RNA, 39 nt, Artificial Sequence
  derived and/or modified sequence opt4 from anti-influenza_CDR
gccgccagcaccagcgugcugggcuacggcauggacgug

SEQ ID NO: 37782 - RNA, 39 nt, Artificial Sequence
  derived and/or modified sequence opt4 from anti-influenza_CDR
agcggcagcaccuucaacaucggcagcaacgccguggac

SEQ ID NO: 37783 - RNA, 39 nt, Artificial Sequence
  derived and/or modified sequence opt4 from anti-influenza_CDR
agcggcagcagaagcaacgugggcgacaacagcguguac

SEQ ID NO: 37784 - RNA, 39 nt, Artificial Sequence
  derived and/or modified sequence opt4 from anti-influenza_CDR
agcggcagcagcagcaacaucggcaacgacuacgugagc

SEQ ID NO: 37785 - RNA, 39 nt, Artificial Sequence
  derived and/or modified sequence opt4 from anti-influenza_CDR
ggcggcggcagcuacggcgccuacgagggcuucgacuac

SEQ ID NO: 37786 - RNA, 39 nt, Artificial Sequence
  derived and/or modified sequence opt4 from anti-influenza_CDR
agcggcagcagcagcaacaucggcagcaacuacguguac

SEQ ID NO: 37787 - RNA, 39 nt, Artificial Sequence
  derived and/or modified sequence opt4 from anti-influenza_CDR
gccagaagacagcagcuguacaagggcuacuaccaccac

SEQ ID NO: 37788 - RNA, 39 nt, Artificial Sequence
  derived and/or modified sequence opt4 from anti-influenza_CDR
agcggcagcaccagcaacaucggcuacaaccccgugagc

SEQ ID NO: 37789 - RNA, 39 nt, Artificial Sequence
  derived and/or modified sequence opt4 from anti-influenza_CDR
gccagaggcaugaacuacuacagcgacuacuucgacuac

SEQ ID NO: 37790 - RNA, 39 nt, Artificial Sequence
  derived and/or modified sequence opt4 from anti-influenza_CDR
gccagaggccacagcggcagcuacagacuguucgacuuc

SEQ ID NO: 37791 - RNA, 39 nt, Artificial Sequence
  derived and/or modified sequence opt4 from anti-influenza_CDR
gccaagccccugagaggcagcuacagauacuucgaccug

SEQ ID NO: 37792 - RNA, 39 nt, Artificial Sequence
  derived and/or modified sequence opt4 from anti-influenza_CDR
cccaucugggugaagaccccccugaagcuggccaacggc

SEQ ID NO: 37793 - RNA, 39 nt, Artificial Sequence
  derived and/or modified sequence opt4 from anti-influenza_CDR
caggccagccagagcguguacaacaagaacaaccuggcc

SEQ ID NO: 37794 - RNA, 39 nt, Artificial Sequence
  derived and/or modified sequence opt4 from anti-influenza_CDR
cagagcagcgagagcguguacaagaacaacaaccuggcc

SEQ ID NO: 37795 - RNA, 39 nt, Artificial Sequence
  derived and/or modified sequence opt4 from anti-influenza_CDR
cagagcagccagagcguggacagcaacaaccagcugagc

SEQ ID NO: 37796 - RNA, 39 nt, Artificial Sequence
  derived and/or modified sequence opt4 from anti-influenza_CDR
cagagcagccagagcguggacaacaacaaggaccuggcc

SEQ ID NO: 37797 - RNA, 39 nt, Artificial Sequence
  derived and/or modified sequence opt4 from anti-influenza_CDR
cagagcagccagagcguguacaacaacaacagacugagc

SEQ ID NO: 37798 - RNA, 39 nt, Artificial Sequence
  derived and/or modified sequence opt4 from anti-influenza_CDR
cagagcagccagagcguguacaagaacaacaaccuggcc

SEQ ID NO: 37799 - RNA, 39 nt, Artificial Sequence
  derived and/or modified sequence opt4 from anti-influenza_CDR
ggcggcggcuucggcuggagccagaccuacuucggcuac

SEQ ID NO: 37800 - RNA, 42 nt, Artificial Sequence
  derived and/or modified sequence opt4 from anti-influenza_CDR
uggcugggcagaaccuacuacagaagcaagugguacaacgac

SEQ ID NO: 37801 - RNA, 42 nt, Artificial Sequence
  derived and/or modified sequence opt4 from anti-influenza_CDR
ggcggccuggugggcggcuacgacgaguacuucuucgacuac

SEQ ID NO: 37802 - RNA, 42 nt, Artificial Sequence
  derived and/or modified sequence opt4 from anti-influenza_CDR
caccccaaguacuucuacggcagcggcagcuaccccgacuuc

SEQ ID NO: 37803 - RNA, 42 nt, Artificial Sequence
  derived and/or modified sequence opt4 from anti-influenza_CDR
accggcagcagcagcgacgugggcgccagcaacagcgugagc

SEQ ID NO: 37804 - RNA, 42 nt, Artificial Sequence
  derived and/or modified sequence opt4 from anti-influenza_CDR
ggcgccuacuacgacagcagcggcuaccccgccuucuacauc

SEQ ID NO: 37805 - RNA, 42 nt, Artificial Sequence
  derived and/or modified sequence opt4 from anti-influenza_CDR
accggcagcagcagcaacaucggcagcgacuacgacgugcac

SEQ ID NO: 37806 - RNA, 42 nt, Artificial Sequence
  derived and/or modified sequence opt4 from anti-influenza_CDR
gaguucgagaccagcggcuacuuccacggcagcuucgacuac

SEQ ID NO: 37807 - RNA, 42 nt, Artificial Sequence
  derived and/or modified sequence opt4 from anti-influenza_CDR
gccagcagcaccggcgccgugaccagcagcuacuuccccaac

SEQ ID NO: 37808 - RNA, 42 nt, Artificial Sequence
  derived and/or modified sequence opt4 from anti-influenza_CDR
accggcggcagcagcgacaucggcgccagcaacagcgugagc

SEQ ID NO: 37809 - RNA, 42 nt, Artificial Sequence
  derived and/or modified sequence opt4 from anti-influenza_CDR
accggcagcagcagcgacgugggcggcuacgacuacgugagc

SEQ ID NO: 37810 - RNA, 42 nt, Artificial Sequence
  derived and/or modified sequence opt4 from anti-influenza_CDR
ggcagcagcaccggcgccgugaccagaggccacuaccccuac

SEQ ID NO: 37811 - RNA, 42 nt, Artificial Sequence
  derived and/or modified sequence opt4 from anti-influenza_CDR
ggcagcagcaccggccccgugaccagcggccacuaccccuac

SEQ ID NO: 37812 - RNA, 42 nt, Artificial Sequence; identical to SEQ ID NO: 14886
  derived and/or modified sequence opt4 from anti-influenza_CDR

SEQ ID NO: 37813 - RNA, 42 nt, Artificial Sequence
  derived and/or modified sequence opt4 from anti-influenza_CDR
accggcagcagcagcaacaucggcgccggcuacgacgugcac

SEQ ID NO: 37814 - RNA, 42 nt, Artificial Sequence
  derived and/or modified sequence opt4 from anti-influenza_CDR
aucccccacuacaacuucggcagcggcagcuacuucgacuac

SEQ ID NO: 37815 - RNA, 42 nt, Artificial Sequence
  derived and/or modified sequence opt4 from anti-influenza_CDR
accggcaccagcagcgacgugggcggcuacaacuacgugagc

SEQ ID NO: 37816 - RNA, 42 nt, Artificial Sequence
  derived and/or modified sequence opt4 from anti-influenza_CDR
accggcaccagcagcgacgugggcgccuacaacuacgugagc

SEQ ID NO: 37817 - RNA, 42 nt, Artificial Sequence
  derived and/or modified sequence opt4 from anti-influenza_CDR
gccgagagacccaaggugagaggccaggccggcagaaugaac

SEQ ID NO: 37818 - RNA, 42 nt, Artificial Sequence
  derived and/or modified sequence opt4 from anti-influenza_CDR
ggcagcagacccugggugagaggcgugagcagcagaaucagc

SEQ ID NO: 37819 - RNA, 42 nt, Artificial Sequence
  derived and/or modified sequence opt4 from anti-influenza_CDR
aucuggggcguggccgcccccggcaccgccgccgcccagauc

SEQ ID NO: 37820 - RNA, 42 nt, Artificial Sequence
  derived and/or modified sequence opt4 from anti-influenza_CDR
ugggugagacagccccccggcaagggccuggaguggguggcc

SEQ ID NO: 37821 - RNA, 42 nt, Artificial Sequence
  derived and/or modified sequence opt4 from anti-influenza_CDR
gccagaggccccgagggcguguggggcagaagcaucgacagc

SEQ ID NO: 37822 - RNA, 42 nt, Artificial Sequence
  derived and/or modified sequence opt4 from anti-influenza_CDR
gccagagaccccgacacccccuucgugagagccuucgacagc

SEQ ID NO: 37823 - RNA, 42 nt, Artificial Sequence
  derived and/or modified sequence opt4 from anti-influenza_CDR
accggcagcaccagcgacaucggcagcuacaacuacgugagc

SEQ ID NO: 37824 - RNA, 42 nt, Artificial Sequence
  derived and/or modified sequence opt4 from anti-influenza_CDR
ugggacuggaacuucgaccuguaccugggcugguucgacccc

SEQ ID NO: 37825 - RNA, 42 nt, Artificial Sequence; identical to SEQ ID NO: 14899
  derived and/or modified sequence opt4 from anti-influenza_CDR

SEQ ID NO: 37826 - RNA, 42 nt, Artificial Sequence
  derived and/or modified sequence opt4 from anti-influenza_CDR
ggccccggcuacagcggcuaccacuacggcugguucgacacc

SEQ ID NO: 37827 - RNA, 42 nt, Artificial Sequence
  derived and/or modified sequence opt4 from anti-influenza_CDR
gccagaugggacuacggcguguacgagggcuacaucgacuac

SEQ ID NO: 37828 - RNA, 45 nt, Artificial Sequence
  derived and/or modified sequence opt4 from anti-influenza_CDR
gccagagccggcaccacccugaccagauucaacugguucgacccc

SEQ ID NO: 37829 - RNA, 45 nt, Artificial Sequence
  derived and/or modified sequence opt4 from anti-influenza_CDR
gccagagccggcaccaccgugaccagauucaacugguucgacccc

SEQ ID NO: 37830 - RNA, 45 nt, Artificial Sequence
  derived and/or modified sequence opt4 from anti-influenza_CDR
gccagaggccagagauacuacuacgacagagacggcauggacgug

SEQ ID NO: 37831 - RNA, 45 nt, Artificial Sequence
  derived and/or modified sequence opt4 from anti-influenza_CDR
gccagaagcggcggcuaccugccccagaacaacuggaucgacccc

SEQ ID NO: 37832 - RNA, 45 nt, Artificial Sequence
  derived and/or modified sequence opt4 from anti-influenza_CDR
auggagaacgagagaacccuggacuuccacgacagcaacgugaag

SEQ ID NO: 37833 - RNA, 45 nt, Artificial Sequence
  derived and/or modified sequence opt4 from anti-influenza_CDR
ggcgccgaccacggcagcggcagcaacuucgugagccccuacgug

SEQ ID NO: 37834 - RNA, 45 nt, Artificial Sequence
  derived and/or modified sequence opt4 from anti-influenza_CDR
gacaccagaagcagccuggacaacuaccaguacggcauggacgug

SEQ ID NO: 37835 - RNA, 45 nt, Artificial Sequence
  derived and/or modified sequence opt4 from anti-influenza_CDR
gaggacuacgacauccugaccggcgccggccccggcauggaggug

SEQ ID NO: 37836 - RNA, 45 nt, Artificial Sequence
  derived and/or modified sequence opt4 from anti-influenza_CDR
caccccuacgacgugcugaccggcagcggcgacugguucgacccc

SEQ ID NO: 37837 - RNA, 45 nt, Artificial Sequence
  derived and/or modified sequence opt4 from anti-influenza_CDR
ggcgccgaccacggcagcggcaacaacuucgugagccccuacgug

SEQ ID NO: 37838 - RNA, 45 nt, Artificial Sequence
  derived and/or modified sequence opt4 from anti-influenza_CDR
gugaucuacagcggcggcagcaccuacuacgccgacagcgugaag

SEQ ID NO: 37839 - RNA, 45 nt, Artificial Sequence
  derived and/or modified sequence opt4 from anti-influenza_CDR
ugguaccagcagaagcccggcaaggcccccaagcugcugaucuac

SEQ ID NO: 37840 - RNA, 45 nt, Artificial Sequence; identical to SEQ ID NO: 22556
  derived and/or modified sequence opt4 from anti-influenza_CDR

SEQ ID NO: 37841 - RNA, 45 nt, Artificial Sequence
  derived and/or modified sequence opt4 from anti-influenza_CDR
gccagagcccacaccgcccugaccagauucagauggcuggacccc

SEQ ID NO: 37842 - RNA, 45 nt, Artificial Sequence
  derived and/or modified sequence opt4 from anti-influenza_CDR
gccagccuggacuacgacuucagcuacuacuaccacagagacgug

SEQ ID NO: 37843 - RNA, 45 nt, Artificial Sequence
  derived and/or modified sequence opt4 from anti-influenza_CDR
gccagaguggccacccccuacuacuacgagagcggcuucgacuac

SEQ ID NO: 37844 - RNA, 45 nt, Artificial Sequence
  derived and/or modified sequence opt4 from anti-influenza_CDR
gccagaagaggcggcggcuggcaguacuacuacggcauggacgug

SEQ ID NO: 37845 - RNA, 48 nt, Artificial Sequence
  derived and/or modified sequence opt4 from anti-influenza_CDR
agcggccacaucaccguguucggcgugaacguggacgccuucgacaug

SEQ ID NO: 37846 - RNA, 48 nt, Artificial Sequence
  derived and/or modified sequence opt4 from anti-influenza_CDR
ggcggccacaucaccguguucggccugaacaucgacgccuacgacauc

SEQ ID NO: 37847 - RNA, 48 nt, Artificial Sequence
  derived and/or modified sequence opt4 from anti-influenza_CDR
ggcggccacaucaccgaguucggccugaacaucgacgccuacgacauc

SEQ ID NO: 37848 - RNA, 48 nt, Artificial Sequence
  derived and/or modified sequence opt4 from anti-influenza_CDR
ggcggccacaucaccguguucggcgugaacaucgacgccuucgacauc

SEQ ID NO: 37849 - RNA, 48 nt, Artificial Sequence
  derived and/or modified sequence opt4 from anti-influenza_CDR
ggcggccacaucaccguguucggcgugaacaucgacgccuucgacgug

SEQ ID NO: 37850 - RNA, 48 nt, Artificial Sequence
  derived and/or modified sequence opt4 from anti-influenza_CDR
gccagagacggcuggggccagcagcuggugcccuacuacuucgacuac

SEQ ID NO: 37851 - RNA, 48 nt, Artificial Sequence
  derived and/or modified sequence opt4 from anti-influenza_CDR
gacuucugggugagcuacuacuacgacagcagcgccccccccgccauc

SEQ ID NO: 37852 - RNA, 48 nt, Artificial Sequence
  derived and/or modified sequence opt4 from anti-influenza_CDR
gccagagccggcgugaagaucuucggccugaucgugggcgcccuggac

SEQ ID NO: 37853 - RNA, 48 nt, Artificial Sequence
  derived and/or modified sequence opt4 from anti-influenza_CDR
gccagagacggcgccggcagcuacuacccccugaacugguucgacccc

SEQ ID NO: 37854 - RNA, 48 nt, Artificial Sequence
  derived and/or modified sequence opt4 from anti-influenza_CDR
gugaucuacagccacggcagagccuacuacagcgccagcgugaacggc

SEQ ID NO: 37855 - RNA, 48 nt, Artificial Sequence
  derived and/or modified sequence opt4 from anti-influenza_CDR
gacacccugcacaacggcuacaccaacuacaaccccagccugagaggc

SEQ ID NO: 37856 - RNA, 48 nt, Artificial Sequence
  derived and/or modified sequence opt4 from anti-influenza_CDR
uacaucagcuacaacggcagacccaaguacaaccccagccugaccagc

SEQ ID NO: 37857 - RNA, 48 nt, Artificial Sequence
  derived and/or modified sequence opt4 from anti-influenza_CDR
gagaccagauucggcgagcugcugagccccuacgacgccuucgagauc

SEQ ID NO: 37858 - RNA, 48 nt, Artificial Sequence
  derived and/or modified sequence opt4 from anti-influenza_CDR
cugaucuacugggacgacgacaagagauacagccccagccugaagaga

SEQ ID NO: 37859 - RNA, 48 nt, Artificial Sequence
  derived and/or modified sequence opt4 from anti-influenza_CDR
uacaucuacuacaucggcaacaccgacuacagacccagccugaagagc

SEQ ID NO: 37860 - RNA, 48 nt, Artificial Sequence
  derived and/or modified sequence opt4 from anti-influenza_CDR
gagaucagccacggcggcagcaccaacuacaaccccagccugaagagc

SEQ ID NO: 37861 - RNA, 48 nt, Artificial Sequence
  derived and/or modified sequence opt4 from anti-influenza_CDR
gagaucaaccacagcggcagaaccaacuacaaccccagccugaagagc

SEQ ID NO: 37862 - RNA, 48 nt, Artificial Sequence
  derived and/or modified sequence opt4 from anti-influenza_CDR
cugaucagcugggacgacgagaagcacuacagccccagccugcagagc

SEQ ID NO: 37863 - RNA, 48 nt, Artificial Sequence
  derived and/or modified sequence opt4 from anti-influenza_CDR
gagggcguguacuucgacagcggcaccuacagaggcuacuucgacuac

SEQ ID NO: 37864 - RNA, 48 nt, Artificial Sequence
  derived and/or modified sequence opt4 from anti-influenza_CDR
uacaucuaccacagcggcagcaccaacuacaaccccagccugaagagc

SEQ ID NO: 37865 - RNA, 48 nt, Artificial Sequence
  derived and/or modified sequence opt4 from anti-influenza_CDR
uacaucuacuacagaggcagcaccuucuacaaccccagccugaagagc

SEQ ID NO: 37866 - RNA, 48 nt, Artificial Sequence
  derived and/or modified sequence opt4 from anti-influenza_CDR
uacaucagcuacagcggcagcaccaaguacaaccccagccugagaagc

SEQ ID NO: 37867 - RNA, 48 nt, Artificial Sequence
  derived and/or modified sequence opt4 from anti-influenza_CDR
gagaucaagcacagcggcagaaccaacuacaaccccagccuggagagc

SEQ ID NO: 37868 - RNA, 48 nt, Artificial Sequence
  derived and/or modified sequence opt4 from anti-influenza_CDR
gagaucaaccacagcggcggcaccaacuacaaccccagccugaagaga

SEQ ID NO: 37869 - RNA, 48 nt, Artificial Sequence
  derived and/or modified sequence opt4 from anti-influenza_CDR
uucauguacuacagcgccagcaccuacuacaaccccagccugaagagc

SEQ ID NO: 37870 - RNA, 48 nt, Artificial Sequence
  derived and/or modified sequence opt4 from anti-influenza_CDR
uacguguacuacagcggcagcaccaccuacaaccccagccugaagagc

SEQ ID NO: 37871 - RNA, 48 nt, Artificial Sequence
  derived and/or modified sequence opt4 from anti-influenza_CDR
aacaucuacuacaccggcaucaccuucuacaaccccagccugagcagc

SEQ ID NO: 37872 - RNA, 48 nt, Artificial Sequence
  derived and/or modified sequence opt4 from anti-influenza_CDR
uucaucuacuacggcggcaacaccaaguacaaccccagccugaagagc

SEQ ID NO: 37873 - RNA, 48 nt, Artificial Sequence
  derived and/or modified sequence opt4 from anti-influenza_CDR
uucauguuccacagcggcagccccagauacaaccccacccugaagagc

SEQ ID NO: 37874 - RNA, 48 nt, Artificial Sequence
  derived and/or modified sequence opt4 from anti-influenza_CDR
uucuucuacaacggcggcagcaccaaguacaaccccagccugaagagc

SEQ ID NO: 37875 - RNA, 48 nt, Artificial Sequence
  derived and/or modified sequence opt4 from anti-influenza_CDR
cacaucuacgacuacggcagaaccuucuacaacagcagccugcagagc

SEQ ID NO: 37876 - RNA, 48 nt, Artificial Sequence
  derived and/or modified sequence opt4 from anti-influenza_CDR
guguucuacagcgagaccagaaccuacuacgccgacagcgugaagggc

SEQ ID NO: 37877 - RNA, 48 nt, Artificial Sequence
  derived and/or modified sequence opt4 from anti-influenza_CDR
uacguguacaacagaggcagcaccaaguacagccccagccugaagagc

SEQ ID NO: 37878 - RNA, 48 nt, Artificial Sequence
  derived and/or modified sequence opt4 from anti-influenza_CDR
uacaucuacaacagaggcagcaccaaguacacccccagccugaagagc

SEQ ID NO: 37879 - RNA, 48 nt, Artificial Sequence
  derived and/or modified sequence opt4 from anti-influenza_CDR
uaccuguacuacagcggcagcaccaaguacaaccccagccugaagagc

SEQ ID NO: 37880 - RNA, 48 nt, Artificial Sequence
  derived and/or modified sequence opt4 from anti-influenza_CDR
uacguguacaacagcggcaacaccaaguacaaccccagccugaagagc

SEQ ID NO: 37881 - RNA, 48 nt, Artificial Sequence
  derived and/or modified sequence opt4 from anti-influenza_CDR
cacaucuucgacagcggcagcaccuacuacaaccccagccugaagagc

SEQ ID NO: 37882 - RNA, 48 nt, Artificial Sequence
  derived and/or modified sequence opt4 from anti-influenza_CDR
guguucuacagcgccgacagaaccagcuacgccgacagcgugaagggc

SEQ ID NO: 37883 - RNA, 48 nt, Artificial Sequence
  derived and/or modified sequence opt4 from anti-influenza_CDR
uacaucuacuacagcggcaacaccuacuacaaccccagccugaagagc

SEQ ID NO: 37884 - RNA, 48 nt, Artificial Sequence
  derived and/or modified sequence opt4 from anti-influenza_CDR
agaagcagccagagccugcugcacagcaacggcuacaacuaccuggac

SEQ ID NO: 37885 - RNA, 48 nt, Artificial Sequence
  derived and/or modified sequence opt4 from anti-influenza_CDR
accaucuaccacagcggcagcaccuacuacaaccccagccugaagagc

SEQ ID NO: 37886 - RNA, 48 nt, Artificial Sequence
  derived and/or modified sequence opt4 from anti-influenza_CDR
agaagcagccagagccugcugcacagcaacggccacaucuacuucgac

SEQ ID NO: 37887 - RNA, 48 nt, Artificial Sequence
  derived and/or modified sequence opt4 from anti-influenza_CDR
aucuggggcguggccgcccccagcaccgccagcgcccagaccagccug

SEQ ID NO: 37888 - RNA, 48 nt, Artificial Sequence
  derived and/or modified sequence opt4 from anti-influenza_CDR
agaagcagccagagccugcuguacaccgacggcuucaccuaccugagc

SEQ ID NO: 37889 - RNA, 48 nt, Artificial Sequence
  derived and/or modified sequence opt4 from anti-influenza_CDR
gccaagcccagacuggacuaccuggacuacuuccacgccgccgacagc

SEQ ID NO: 37890 - RNA, 48 nt, Artificial Sequence
  derived and/or modified sequence opt4 from anti-influenza_CDR
gccagaagccccggcuacagcggcuaccuguacggcugguucgacccc

SEQ ID NO: 37891 - RNA, 48 nt, Artificial Sequence
  derived and/or modified sequence opt4 from anti-influenza_CDR
gccaucgccggcagcggcagcgccgacuacgccagcugggccaagggc

SEQ ID NO: 37892 - RNA, 48 nt, Artificial Sequence
  derived and/or modified sequence opt4 from anti-influenza_CDR
gccaucgccggcagcggcagcgccgacuacgccagcugggccaagagc

SEQ ID NO: 37893 - RNA, 48 nt, Artificial Sequence
  derived and/or modified sequence opt4 from anti-influenza_CDR
gccaucggcggcggcggcagcgccgacuacgccagcugggccaagagc

SEQ ID NO: 37894 - RNA, 48 nt, Artificial Sequence
  derived and/or modified sequence opt4 from anti-influenza_CDR
agaagcagccagagccugcugagaagcaacggcuacaacuaccuggac

SEQ ID NO: 37895 - RNA, 48 nt, Artificial Sequence
  derived and/or modified sequence opt4 from anti-influenza_CDR
cagggcgaccacaucgccuggcugcugagaggcaucaacuucgacuac

SEQ ID NO: 37896 - RNA, 51 nt, Artificial Sequence
  derived and/or modified sequence opt4 from anti-influenza_CDR
gccagacugggcagcggcagcuaccacaacggccccaacugguucgacccc

SEQ ID NO: 37897 - RNA, 51 nt, Artificial Sequence
  derived and/or modified sequence opt4 from anti-influenza_CDR
gccagagccgagaaccugcugagccccuaccuggccgagggcuucgacccc

SEQ ID NO: 37898 - RNA, 51 nt, Artificial Sequence
  derived and/or modified sequence opt4 from anti-influenza_CDR
gugaucagcuacgacggcagcaacaaguacuacgccgacagcgugaagggc

SEQ ID NO: 37899 - RNA, 51 nt, Artificial Sequence
  derived and/or modified sequence opt4 from anti-influenza_CDR
ggcaccaucccccugcugggcaccaccaacuacgcccagaaguuccagggc

SEQ ID NO: 37900 - RNA, 51 nt, Artificial Sequence
  derived and/or modified sequence opt4 from anti-influenza_CDR
ggcaucaucgccguguucaacaccgccaacuacgcccagaaguuccagggc

SEQ ID NO: 37901 - RNA, 51 nt, Artificial Sequence
  derived and/or modified sequence opt4 from anti-influenza_CDR
aacaucgaggacgacggcggcgacaaguacuacguggacagcgugaagggc

SEQ ID NO: 37902 - RNA, 51 nt, Artificial Sequence
  derived and/or modified sequence opt4 from anti-influenza_CDR
uggaucaaccccaacagcggcaccaccggcagcgcccagagauuccagggc

SEQ ID NO: 37903 - RNA, 51 nt, Artificial Sequence
  derived and/or modified sequence opt4 from anti-influenza_CDR
ggcaucaaccccguguucggcagaccccacuacgcccagaaguuccagggc

SEQ ID NO: 37904 - RNA, 51 nt, Artificial Sequence
  derived and/or modified sequence opt4 from anti-influenza_CDR
ggcaucaucccccugaucaacgcccccaacuacgcccccaaguuccagggc

SEQ ID NO: 37905 - RNA, 51 nt, Artificial Sequence
  derived and/or modified sequence opt4 from anti-influenza_CDR
ggcaucauccccaugaugggcaccgugaacuacgcccagaagcugcagggc

SEQ ID NO: 37906 - RNA, 51 nt, Artificial Sequence
  derived and/or modified sequence opt4 from anti-influenza_CDR
ggcaucaucccccuguucggcgccgccaaguacgcccagaaguuccagggc

SEQ ID NO: 37907 - RNA, 51 nt, Artificial Sequence
  derived and/or modified sequence opt4 from anti-influenza_CDR
aagagcagccagagagugcuguacagcagcaacaacaagaacuaccuggcc

SEQ ID NO: 37908 - RNA, 51 nt, Artificial Sequence
  derived and/or modified sequence opt4 from anti-influenza_CDR
cugaucagcgacgacggcagcaacaaguucuacgccgacagcgugaagggc

SEQ ID NO: 37909 - RNA, 51 nt, Artificial Sequence
  derived and/or modified sequence opt4 from anti-influenza_CDR
aucaucagcuacgacggcaacgaccaguacuacaccgacagcgugaagggc

SEQ ID NO: 37910 - RNA, 51 nt, Artificial Sequence
  derived and/or modified sequence opt4 from anti-influenza_CDR
uggaucagcaccuacaacggcaacaccaacuucgcccagaacuuccagggc

SEQ ID NO: 37911 - RNA, 51 nt, Artificial Sequence
  derived and/or modified sequence opt4 from anti-influenza_CDR
guggagggcagcuacagagacuucuggaacaaccagaacagauucgacccc

SEQ ID NO: 37912 - RNA, 51 nt, Artificial Sequence
  derived and/or modified sequence opt4 from anti-influenza_CDR
uggaucaaccccaacagcggcgacaccaacuacgcccagaaguuccagggc

SEQ ID NO: 37913 - RNA, 51 nt, Artificial Sequence
  derived and/or modified sequence opt4 from anti-influenza_CDR
aagagcagccagagcgugcuguacagcagcaacaacaagagccaccuggcc

SEQ ID NO: 37914 - RNA, 51 nt, Artificial Sequence
  derived and/or modified sequence opt4 from anti-influenza_CDR
aucaucuaccccggcgacagcgacaccagauacagccccagcuuccagggc

SEQ ID NO: 37915 - RNA, 51 nt, Artificial Sequence
  derived and/or modified sequence opt4 from anti-influenza_CDR
ggcaucauccccguguuccccacccccaacuacgcccagauguuccagggc

SEQ ID NO: 37916 - RNA, 51 nt, Artificial Sequence
  derived and/or modified sequence opt4 from anti-influenza_CDR
ggcaucgugcccguguucggcaccgccaacuacgcccagaaguuccagggc

SEQ ID NO: 37917 - RNA, 51 nt, Artificial Sequence
  derived and/or modified sequence opt4 from anti-influenza_CDR
uggaucaaccccgagagcggcgacaccaaguacgcccagaaguuccagggc

SEQ ID NO: 37918 - RNA, 51 nt, Artificial Sequence
  derived and/or modified sequence opt4 from anti-influenza_CDR
agaagcagccagagcaucuuccacaacagcaacaacgagaacuaccuggcc

SEQ ID NO: 37919 - RNA, 51 nt, Artificial Sequence
  derived and/or modified sequence opt4 from anti-influenza_CDR
uggaucaacgccaagagaggcggcaccaacuacgcccagaaguuccagggc

SEQ ID NO: 37920 - RNA, 51 nt, Artificial Sequence
  derived and/or modified sequence opt4 from anti-influenza_CDR
uggaucaaccccgacagcggcgccaccagcagcgcccagaacuuccagggc

SEQ ID NO: 37921 - RNA, 51 nt, Artificial Sequence
  derived and/or modified sequence opt4 from anti-influenza_CDR
uggaucagccccgacagcgacgccaccaaguacgcccagaaguuccagggc

SEQ ID NO: 37922 - RNA, 51 nt, Artificial Sequence
  derived and/or modified sequence opt4 from anti-influenza_CDR
aacaucaagcaggacggcagagagaaguacuacguggacagccugagaggc

SEQ ID NO: 37923 - RNA, 51 nt, Artificial Sequence; identical to SEQ ID NO: 22639
  derived and/or modified sequence opt4 from anti-influenza_CDR

SEQ ID NO: 37924 - RNA, 51 nt, Artificial Sequence
  derived and/or modified sequence opt4 from anti-influenza_CDR
aagagcagccagagcauccugaacagcagcaacaacaagaacuaccuggcc

SEQ ID NO: 37925 - RNA, 51 nt, Artificial Sequence
  derived and/or modified sequence opt4 from anti-influenza_CDR
uggaucagcgccuacaacggcaacaccaacuacgcccagaaguuccagggc

SEQ ID NO: 37926 - RNA, 51 nt, Artificial Sequence
  derived and/or modified sequence opt4 from anti-influenza_CDR
ggcgugauccccaucuucagaaccgccaacuacgcccagaacuuccagggc

SEQ ID NO: 37927 - RNA, 51 nt, Artificial Sequence; identical to SEQ ID NO: 22643
  derived and/or modified sequence opt4 from anti-influenza_CDR

SEQ ID NO: 37928 - RNA, 51 nt, Artificial Sequence
  derived and/or modified sequence opt4 from anti-influenza_CDR
ggcaucagccccauguucggcaccaccaccuacgcccagaaguuccagggc

SEQ ID NO: 37929 - RNA, 51 nt, Artificial Sequence
  derived and/or modified sequence opt4 from anti-influenza_CDR
aagagcagccagagcgugcuguacagcagcaacaacaagaacuaccuggcc

SEQ ID NO: 37930 - RNA, 51 nt, Artificial Sequence; identical to SEQ ID NO: 22646
  derived and/or modified sequence opt4 from anti-influenza_CDR

SEQ ID NO: 37931 - RNA, 51 nt, Artificial Sequence
  derived and/or modified sequence opt4 from anti-influenza_CDR
ggcaucagcccccuguucggcaccaccaacuacgcccagaaguuccagggc

SEQ ID NO: 37932 - RNA, 51 nt, Artificial Sequence; identical to SEQ ID NO: 22648
  derived and/or modified sequence opt4 from anti-influenza_CDR

SEQ ID NO: 37933 - RNA, 51 nt, Artificial Sequence
  derived and/or modified sequence opt4 from anti-influenza_CDR
ggcaucaucggcauguucggcagcaccaacuacgcccagaacuuccagggc

SEQ ID NO: 37934 - RNA, 51 nt, Artificial Sequence
  derived and/or modified sequence opt4 from anti-influenza_CDR
uggaucaaccccaacagcggcggcaccaacuacgcccagaaguuccagggc

SEQ ID NO: 37935 - RNA, 51 nt, Artificial Sequence
  derived and/or modified sequence opt4 from anti-influenza_CDR
gccaucagcagcagcggcgacagcaccuacuacgccgacagcgugaagggc

SEQ ID NO: 37936 - RNA, 51 nt, Artificial Sequence
  derived and/or modified sequence opt4 from anti-influenza_CDR
agcaucagcagcagcagcagcuacaucuacuacguggacagcgugaagggc

SEQ ID NO: 37937 - RNA, 51 nt, Artificial Sequence
  derived and/or modified sequence opt4 from anti-influenza_CDR
gacaucaucggcauguucggcagcaccaacuacgcccagaacuuccagggc

SEQ ID NO: 37938 - RNA, 51 nt, Artificial Sequence; identical to SEQ ID NO: 22654
  derived and/or modified sequence opt4 from anti-influenza_CDR

SEQ ID NO: 37939 - RNA, 51 nt, Artificial Sequence; identical to SEQ ID NO: 22655
  derived and/or modified sequence opt4 from anti-influenza_CDR

SEQ ID NO: 37940 - RNA, 51 nt, Artificial Sequence; identical to SEQ ID NO: 22656
  derived and/or modified sequence opt4 from anti-influenza_CDR

SEQ ID NO: 37941 - RNA, 51 nt, Artificial Sequence
  derived and/or modified sequence opt4 from anti-influenza_CDR
ggcaucuucgcccuguucggcaccaccgacuacgcccagaaguuccagggc

SEQ ID NO: 37942 - RNA, 51 nt, Artificial Sequence; identical to SEQ ID NO: 22658
  derived and/or modified sequence opt4 from anti-influenza_CDR

SEQ ID NO: 37943 - RNA, 51 nt, Artificial Sequence
  derived and/or modified sequence opt4 from anti-influenza_CDR
ggcaucaucgccguguucggcaccaccaaguacgcccacaaguuccagggc

SEQ ID NO: 37944 - RNA, 51 nt, Artificial Sequence
  derived and/or modified sequence opt4 from anti-influenza_CDR
ggcauccugggcguguucggcagccccagcuacgcccagaaguuccagggc

SEQ ID NO: 37945 - RNA, 51 nt, Artificial Sequence; identical to SEQ ID NO: 22661
  derived and/or modified sequence opt4 from anti-influenza_CDR

SEQ ID NO: 37946 - RNA, 51 nt, Artificial Sequence
  derived and/or modified sequence opt4 from anti-influenza_CDR
uggaucagcgccuacaccggcgacaccgacuacgcccagaaguuccagggc

SEQ ID NO: 37947 - RNA, 51 nt, Artificial Sequence
  derived and/or modified sequence opt4 from anti-influenza_CDR
agcuucgaccccgaggacggcgagaccaucuacgcccagaaguuccagggc

SEQ ID NO: 37948 - RNA, 51 nt, Artificial Sequence
  derived and/or modified sequence opt4 from anti-influenza_CDR
ggcaucagcggcagcggcgagagcaccuacuacgccgacagcgugaagggc

SEQ ID NO: 37949 - RNA, 51 nt, Artificial Sequence
  derived and/or modified sequence opt4 from anti-influenza_CDR
guggugagcuacgacggcaacuacaaguacuacgccgacagcgugcagggc

SEQ ID NO: 37950 - RNA, 51 nt, Artificial Sequence
  derived and/or modified sequence opt4 from anti-influenza_CDR
ggcagcaucagcuacagcggcagcaccuacuaccaccccagccugaagagc

SEQ ID NO: 37951 - RNA, 51 nt, Artificial Sequence
  derived and/or modified sequence opt4 from anti-influenza_CDR
accagaggcagacccaucggcagaaacugggagcccagagacaaggacuac

SEQ ID NO: 37952 - RNA, 51 nt, Artificial Sequence
  derived and/or modified sequence opt4 from anti-influenza_CDR
gccagagaggccggcuaccacagcagcuucagcggcguguacuucgacuac

SEQ ID NO: 37953 - RNA, 51 nt, Artificial Sequence
  derived and/or modified sequence opt4 from anti-influenza_CDR
agaaucgaccccaacggcagcggcaccaccuacgcccagaaguuccagggc

SEQ ID NO: 37954 - RNA, 51 nt, Artificial Sequence
  derived and/or modified sequence opt4 from anti-influenza_CDR
agaaucgaccccaacggcgccggcaccaccuacgcccagaaguuccagggc

SEQ ID NO: 37955 - RNA, 51 nt, Artificial Sequence; identical to SEQ ID NO: 22671
  derived and/or modified sequence opt4 from anti-influenza_CDR

SEQ ID NO: 37956 - RNA, 51 nt, Artificial Sequence
  derived and/or modified sequence opt4 from anti-influenza_CDR
augauguaccccggcgacagcgacaccaucuacagccccagcuuccagggc

SEQ ID NO: 37957 - RNA, 51 nt, Artificial Sequence
  derived and/or modified sequence opt4 from anti-influenza_CDR
augauguaccccggcgacgccgacgccaucuacagccccagcuuccagggc

SEQ ID NO: 37958 - RNA, 51 nt, Artificial Sequence
  derived and/or modified sequence opt4 from anti-influenza_CDR
augauguaccccggcgagagcgagaccaucuacagccccagcuuccagggc

SEQ ID NO: 37959 - RNA, 51 nt, Artificial Sequence
  derived and/or modified sequence opt4 from anti-influenza_CDR
augauguaccccggcgacgccgacaccaucuacagccccagcuuccagggc

SEQ ID NO: 37960 - RNA, 51 nt, Artificial Sequence
  derived and/or modified sequence opt4 from anti-influenza_CDR
augauguaccccggcagcagcgacaccaucuacagccccagcuuccagggc

SEQ ID NO: 37961 - RNA, 51 nt, Artificial Sequence
  derived and/or modified sequence opt4 from anti-influenza_CDR
augauguaccccggcgacagcgacgccaucuacagccccagcuuccagggc

SEQ ID NO: 37962 - RNA, 51 nt, Artificial Sequence
  derived and/or modified sequence opt4 from anti-influenza_CDR
augauguaccccggcgacaccgacaccaucuacagccccagcuuccagggc

SEQ ID NO: 37963 - RNA, 51 nt, Artificial Sequence
  derived and/or modified sequence opt4 from anti-influenza_CDR
augauguaccccggcgagagcgacaccaucuacagccccagcuuccagggc

SEQ ID NO: 37964 - RNA, 51 nt, Artificial Sequence
  derived and/or modified sequence opt4 from anti-influenza_CDR
gugaucagcugggacagcggcagaaucggcuacgccgacagcgugaagggc

SEQ ID NO: 37965 - RNA, 51 nt, Artificial Sequence
  derived and/or modified sequence opt4 from anti-influenza_CDR
gugagaagcggcgccuacuacuucaacuaccuggugcccuacuucgacuac

SEQ ID NO: 37966 - RNA, 51 nt, Artificial Sequence
  derived and/or modified sequence opt4 from anti-influenza_CDR
gugagaagcggcgccuacuacgugaacuaccuggugcccuacuucgacuac

SEQ ID NO: 37967 - RNA, 51 nt, Artificial Sequence
  derived and/or modified sequence opt4 from anti-influenza_CDR
aucaucagcugggacagcggcagaaucggcuacgccgacagcgugagaggc

SEQ ID NO: 37968 - RNA, 51 nt, Artificial Sequence
  derived and/or modified sequence opt4 from anti-influenza_CDR
cacggcggcguguacuacuacggcagcgccagcagcggcugguucgacccc

SEQ ID NO: 37969 - RNA, 54 nt, Artificial Sequence
  derived and/or modified sequence opt4 from anti-influenza_CDR
agaaccuacuacagaagcaagugguacaacgacuacgccgagagcgugaagagc

SEQ ID NO: 37970 - RNA, 54 nt, Artificial Sequence
  derived and/or modified sequence opt4 from anti-influenza_CDR
agaaccuacuacagaagcaagugguacuacgacuacgccgagagcgugaagagc

SEQ ID NO: 37971 - RNA, 54 nt, Artificial Sequence
  derived and/or modified sequence opt4 from anti-influenza_CDR
agaaccuacuacagaagcaagugguacaacgacuacgccgugagcgugaagagc

SEQ ID NO: 37972 - RNA, 54 nt, Artificial Sequence
  derived and/or modified sequence opt4 from anti-influenza_CDR
agaaccuacuacagaagcaagugguacaacgacuacgccgacuuccugaagaga

SEQ ID NO: 37973 - RNA, 54 nt, Artificial Sequence
  derived and/or modified sequence opt4 from anti-influenza_CDR
agaaccuacuacagaagcggcugguacaacgacuacgccgagagcgugaagagc

SEQ ID NO: 37974 - RNA, 54 nt, Artificial Sequence
  derived and/or modified sequence opt4 from anti-influenza_CDR
gccagacugggcggcaacaaggacuacggcgacuaccugugguacuucgaccug

SEQ ID NO: 37975 - RNA, 54 nt, Artificial Sequence
  derived and/or modified sequence opt4 from anti-influenza_CDR
gccaaggacaccgccgaccacggcgacuacguggaccugggcuucuucgacgcc

SEQ ID NO: 37976 - RNA, 54 nt, Artificial Sequence
  derived and/or modified sequence opt4 from anti-influenza_CDR
gccagaagcggcaucuucgacuggagcgccccccugguggaggccuucgacauc

SEQ ID NO: 37977 - RNA, 54 nt, Artificial Sequence
  derived and/or modified sequence opt4 from anti-influenza_CDR
gccagacacgccagcugcagcgccagaagcugcuacuggggccccguggacuac

SEQ ID NO: 37978 - RNA, 54 nt, Artificial Sequence
  derived and/or modified sequence opt4 from anti-influenza_CDR
gacgccccccccaacguggagguggccagcaugaccaacugguacuucgaccug

SEQ ID NO: 37979 - RNA, 54 nt, Artificial Sequence
  derived and/or modified sequence opt4 from anti-influenza_CDR
cugagaaccgacuacggcgaccccgacagcguguacuacuacggcauggacgug

SEQ ID NO: 37980 - RNA, 54 nt, Artificial Sequence
  derived and/or modified sequence opt4 from anti-influenza_CDR
ggcaccugcgccggcgacugcagccugcacuacuacuacuacggccuggacgug

SEQ ID NO: 37981 - RNA, 54 nt, Artificial Sequence
  derived and/or modified sequence opt4 from anti-influenza_CDR
cacgugagcgugagccacggcggcagaaccaagagcaaccccagcgugaugagc

SEQ ID NO: 37982 - RNA, 54 nt, Artificial Sequence
  derived and/or modified sequence opt4 from anti-influenza_CDR
gcccugaucuacuucgacggcagcaagcaguacuacgccgacagcgugaagggc

SEQ ID NO: 37983 - RNA, 54 nt, Artificial Sequence
  derived and/or modified sequence opt4 from anti-influenza_CDR
acccugaucagcuacgacggcgccaaccaguacuacgccgacagcgugaagggc

SEQ ID NO: 37984 - RNA, 54 nt, Artificial Sequence
  derived and/or modified sequence opt4 from anti-influenza_CDR
gccgugcccggccccguguucggcaucuucccccccuggagcuacuucgacaac

SEQ ID NO: 37985 - RNA, 54 nt, Artificial Sequence; identical to SEQ ID NO: 22701
  derived and/or modified sequence opt4 from anti-influenza_CDR

SEQ ID NO: 37986 - RNA, 54 nt, Artificial Sequence
  derived and/or modified sequence opt4 from anti-influenza_CDR
ggcuggaucagcgccuacaccggcaacacccacuacgccaagaacuucgagggc

SEQ ID NO: 37987 - RNA, 54 nt, Artificial Sequence
  derived and/or modified sequence opt4 from anti-influenza_CDR
ggcuggaucaaccccaacuucggcggcacccacuacgccagaaaguuccagggc

SEQ ID NO: 37988 - RNA, 54 nt, Artificial Sequence
  derived and/or modified sequence opt4 from anti-influenza_CDR
gugagauggagagccgccgccgugaucauggaccaguucuacaagauggacgug

SEQ ID NO: 37989 - RNA, 54 nt, Artificial Sequence
  derived and/or modified sequence opt4 from anti-influenza_CDR
gccgugcccggccccaucuucggcaucuucccccccuggagcuacuucgaccac

SEQ ID NO: 37990 - RNA, 54 nt, Artificial Sequence
  derived and/or modified sequence opt4 from anti-influenza_CDR
gccgccagcaccgccaccagcggcaccuacuacgccaugagacccuucgacuuc

SEQ ID NO: 37991 - RNA, 57 nt, Artificial Sequence
  derived and/or modified sequence opt4 from anti-influenza_CDR
gccagaggcaagagacccggcuacugcagcggcggcgugugcagcagcgacuacugg

SEQ ID NO: 37992 - RNA, 57 nt, Artificial Sequence
  derived and/or modified sequence opt4 from anti-influenza_CDR
gccagacacuaccccuacuacgaccugcccaccggcuucuacagccaguucgacuuc

SEQ ID NO: 37993 - RNA, 57 nt, Artificial Sequence
  derived and/or modified sequence opt4 from anti-influenza_CDR
ggcagcggcggcuacggcggcuucgacuacuucggcaagcugagaaccugggacuuc

SEQ ID NO: 37994 - RNA, 57 nt, Artificial Sequence
  derived and/or modified sequence opt4 from anti-influenza_CDR
uucaucagaaccagacccuggggcggcaccgccgacaccgccgccagcgugaagggc

SEQ ID NO: 37995 - RNA, 57 nt, Artificial Sequence
  derived and/or modified sequence opt4 from anti-influenza_CDR
cugaacuaccacgacagcggcaccuacuacaacgcccccagaggcugguucgacccc

SEQ ID NO: 37996 - RNA, 57 nt, Artificial Sequence
  derived and/or modified sequence opt4 from anti-influenza_CDR
gugaaggacggcuacugcacccugaccagcugccccgugggcugguacuucgaccug

SEQ ID NO: 37997 - RNA, 57 nt, Artificial Sequence
  derived and/or modified sequence opt4 from anti-influenza_CDR
gccgugcccggccccaucuucggcaucuucccccccuggagcuacuucgaccacugg

SEQ ID NO: 37998 - RNA, 57 nt, Artificial Sequence
  derived and/or modified sequence opt4 from anti-influenza_CDR
gccagagccaugauccagggcguggugacccuguaccugagacccggcgacuacugg

SEQ ID NO: 37999 - RNA, 57 nt, Artificial Sequence
  derived and/or modified sequence opt4 from anti-influenza_CDR
gccaaggugggccccuacaccggcuacgacgacuacaacuacuacggcauggacgug

SEQ ID NO: 38000 - RNA, 57 nt, Artificial Sequence
  derived and/or modified sequence opt4 from anti-influenza_CDR
gccaagguggagagaagcuucuacgacggcagcggcuacggcgacgcccuggagauc

SEQ ID NO: 38001 - RNA, 57 nt, Artificial Sequence
  derived and/or modified sequence opt4 from anti-influenza_CDR
uacugcgccagaggcagagugaacagcggcuacgacuggggccccaacuucgacagc

SEQ ID NO: 38002 - RNA, 57 nt, Artificial Sequence
  derived and/or modified sequence opt4 from anti-influenza_CDR
uucugcgccagaggcagccccaacagcggcuacgacuggggcccccacuucgacuac

SEQ ID NO: 38003 - RNA, 57 nt, Artificial Sequence
  derived and/or modified sequence opt4 from anti-influenza_CDR
agaaucaagagcaacaccgacggcggcaccaccgacuacgccgcccccgugaagggc

SEQ ID NO: 38004 - RNA, 57 nt, Artificial Sequence
  derived and/or modified sequence opt4 from anti-influenza_CDR
cugagacugcagggcgaggugguggugccccccagccagagcaacugguucgacccc

SEQ ID NO: 38005 - RNA, 60 nt, Artificial Sequence
  derived and/or modified sequence opt4 from anti-influenza_CDR
gccaaggagggcggcaacaccaucuucggccuggugaccauggccuacuacuucgacagc

SEQ ID NO: 38006 - RNA, 60 nt, Artificial Sequence
  derived and/or modified sequence opt4 from anti-influenza_CDR
gccagagccggcggcgacagcagcggcuacuacggcgcccugggcagauucuuccagcac

SEQ ID NO: 38007 - RNA, 60 nt, Artificial Sequence
  derived and/or modified sequence opt4 from anti-influenza_CDR
gccaaggacagcagaggcuacugcagcagcaucaucugcuucgagggcggccuggacaac

SEQ ID NO: 38008 - RNA, 60 nt, Artificial Sequence
  derived and/or modified sequence opt4 from anti-influenza_CDR
ggcagcggcagcagcgacagaagcgacuacgacccccacuacuacuacuaccuggacgug

SEQ ID NO: 38009 - RNA, 60 nt, Artificial Sequence
  derived and/or modified sequence opt4 from anti-influenza_CDR
ggcaccgaccccgacaccgagguguacugcagagugggcaacugcgccgccuucgacuac

SEQ ID NO: 38010 - RNA, 60 nt, Artificial Sequence
  derived and/or modified sequence opt4 from anti-influenza_CDR
ggcaccagccacgugagcagauacuucgacuggcugccccccaccaacugguucgacccc

SEQ ID NO: 38011 - RNA, 60 nt, Artificial Sequence
  derived and/or modified sequence opt4 from anti-influenza_CDR
ggcaccgaccccgacaccgagggcuacugcagaagcggcagcugcagcgccuucgacuuc

SEQ ID NO: 38012 - RNA, 60 nt, Artificial Sequence
  derived and/or modified sequence opt4 from anti-influenza_CDR
ggcaccgaccccgacaccgagguguacugcagagccggcaacugcgccgccuucgacuuc

SEQ ID NO: 38013 - RNA, 60 nt, Artificial Sequence
  derived and/or modified sequence opt4 from anti-influenza_CDR
agaggcggccacagcuucggcuacggcagcggcggcgacacccacagcgaguucgacagc

SEQ ID NO: 38014 - RNA, 60 nt, Artificial Sequence
  derived and/or modified sequence opt4 from anti-influenza_CDR
cacaugagcaugcagcagguggugagcgccggcugggagagagccgaccuggugggcgac

SEQ ID NO: 38015 - RNA, 60 nt, Artificial Sequence
  derived and/or modified sequence opt4 from anti-influenza_CDR
gacagcagacugagaagccugcuguacuucgaguggcugagccagggcuacuucaacccc

SEQ ID NO: 38016 - RNA, 60 nt, Artificial Sequence
  derived and/or modified sequence opt4 from anti-influenza_CDR
gccagacaccugggccagcagcuggugagcaacaccuacuacuacuacggcauggacgug

SEQ ID NO: 38017 - RNA, 63 nt, Artificial Sequence; identical to SEQ ID NO: 22733
  derived and/or modified sequence opt4 from anti-influenza_CDR

SEQ ID NO: 38018 - RNA, 63 nt, Artificial Sequence
  derived and/or modified sequence opt4 from anti-influenza_CDR
gccagagccgccgacgagagcguggagagccugaccaucaaggccuucagaaccaacuaccac

SEQ ID NO: 38019 - RNA, 63 nt, Artificial Sequence
  derived and/or modified sequence opt4 from anti-influenza_CDR
gccagaaugccccuggccaacuacgaccugcugaccggccuguacaucggcgccuucgaccug

SEQ ID NO: 38020 - RNA, 63 nt, Artificial Sequence
  derived and/or modified sequence opt4 from anti-influenza_CDR
gacaugcuggccuacuacagcgacaacagcggcaagaaguacaacguguacggcauggacgug

SEQ ID NO: 38021 - RNA, 63 nt, Artificial Sequence
  derived and/or modified sequence opt4 from anti-influenza_CDR
gacaugcuggccuacuacuacgacggcagcggcaucagauacaaccuguacggcauggacgug

SEQ ID NO: 38022 - RNA, 66 nt, Artificial Sequence
  derived and/or modified sequence opt4 from anti-influenza_CDR
gccaaggaccccagacugagacaccugcuguacuuccccuucaccagcaugaucuacuucgacuac

SEQ ID NO: 38023 - RNA, 66 nt, Artificial Sequence
  derived and/or modified sequence opt4 from anti-influenza_CDR
gccaaggacagccagcugagaagccugcuguacuucgaguggcugagccagggcuacuucgacccc

SEQ ID NO: 38024 - RNA, 66 nt, Artificial Sequence
  derived and/or modified sequence opt4 from anti-influenza_CDR
gccaaggacagccagcugagaagccugcuguacuucgaguggcugagccagggcuacuucgacuac

SEQ ID NO: 38025 - RNA, 66 nt, Artificial Sequence
  derived and/or modified sequence opt4 from anti-influenza_CDR
gccaaggacagccagcugagaagccugcuguacuucgaguggcugagccagggcuacuucgagccc

SEQ ID NO: 38026 - RNA, 66 nt, Artificial Sequence
  derived and/or modified sequence opt4 from anti-influenza_CDR
gccaaggagagaccccugagacugcugagauacuucgacuggcugagcggcggcgccaacgacuac

SEQ ID NO: 38027 - RNA, 66 nt, Artificial Sequence
  derived and/or modified sequence opt4 from anti-influenza_CDR
gccagagacgugcacaacuacgacuuccugaccggcuacccccugcaccuguacggcauggacgug

SEQ ID NO: 38028 - RNA, 66 nt, Artificial Sequence
  derived and/or modified sequence opt4 from anti-influenza_CDR
gccagagacggcagagagggcuacuucuacggcagcggcagcuucuacaaccugaagggccugaac

SEQ ID NO: 38029 - RNA, 66 nt, Artificial Sequence
  derived and/or modified sequence opt4 from anti-influenza_CDR
agcaccgacagaggccacgugcugagauacuucggcuggaugcugcccggcgacgccuucgacgug

SEQ ID NO: 38030 - RNA, 66 nt, Artificial Sequence
  derived and/or modified sequence opt4 from anti-influenza_CDR
cugaacuacuacgacagaagcggcuaccacagccccgacggccccagcaacaacugguucgacccc

SEQ ID NO: 38031 - RNA, 66 nt, Artificial Sequence
  derived and/or modified sequence opt4 from anti-influenza_CDR
gccagagugcccagagacagacugcugacccuguacuacgagagcagcaccuacggcuucgacuac

SEQ ID NO: 38032 - RNA, 66 nt, Artificial Sequence
  derived and/or modified sequence opt4 from anti-influenza_CDR
gccagaaaguggggcagaaugaccguguucggcguggccaccgaccagcuguacuacuucgacuac

SEQ ID NO: 38033 - RNA, 66 nt, Artificial Sequence
  derived and/or modified sequence opt4 from anti-influenza_CDR
gccaccgacaucgugguggagagagacgccagccugggcggcuucaacagcuacggcauggacgug

SEQ ID NO: 38034 - RNA, 69 nt, Artificial Sequence
  derived and/or modified sequence opt4 from anti-influenza_CDR
gccagaaaccugcccgacaucgccguggugaccgccgugcaggacgccacccccgugugguucgacccc

SEQ ID NO: 38035 - RNA, 69 nt, Artificial Sequence
  derived and/or modified sequence opt4 from anti-influenza_CDR
gacggccccuacagcgacgacuucagaagcggcuacgccgccagauacagauacuucggcauggacgug

SEQ ID NO: 38036 - RNA, 72 nt, Artificial Sequence
  derived and/or modified sequence opt4 from anti-influenza_CDR
ggcagagagcugcugagacugcagcacuuccugaccgacagccagagcgagagaagagacugcuucgacccc

SEQ ID NO: 38037 - RNA, 72 nt, Artificial Sequence
  derived and/or modified sequence opt4 from anti-influenza_CDR
augagccugcugaccgagguggagacccccaccagaaacgaguggggcugcagaugcaacgacagcagcgac

SEQ ID NO: 38038 - RNA, 72 nt, Artificial Sequence
  derived and/or modified sequence opt4 from anti-influenza_CDR
augagccugcugaccgagguggagacccccaccaagaacgagugggagugcagaugcaacgacagcagcgac

SEQ ID NO: 38039 - RNA, 72 nt, Artificial Sequence
  derived and/or modified sequence opt4 from anti-influenza_CDR
augagccugcugaccgagguggagacccccaucagaaacgagugggagugcagaugcaacgacagcagcgac

SEQ ID NO: 38040 - RNA, 72 nt, Artificial Sequence
  derived and/or modified sequence opt4 from anti-influenza_CDR
augagccugcugaccgagguggagacccccaucagaaacggcugggagugcaagugcaacgacagcagcgac

SEQ ID NO: 38041 - RNA, 72 nt, Artificial Sequence
  derived and/or modified sequence opt4 from anti-influenza_CDR
augagccugcugaccgagguggagacccccaucagaagcgaguggggcugcagaugcaacgacagcagcgac

SEQ ID NO: 38042 - RNA, 72 nt, Artificial Sequence
  derived and/or modified sequence opt4 from anti-influenza_CDR
augagcuuccugcccgagguggagacccccaucagaaacgaguggggcugcagaugcaacgacagcagcgac

SEQ ID NO: 38043 - RNA, 72 nt, Artificial Sequence
  derived and/or modified sequence opt4 from anti-influenza_CDR
augagccugcugaccgagguggagacccccaucagaaacgaguggggcugcagaugcaacgacagcagcaac

SEQ ID NO: 38044 - RNA, 72 nt, Artificial Sequence
  derived and/or modified sequence opt4 from anti-influenza_CDR
augagccugcugaccgagguggagacccccaucagaaaggaguggggcugcagaugcaacgacagcagcgac

SEQ ID NO: 38045 - RNA, 72 nt, Artificial Sequence
  derived and/or modified sequence opt4 from anti-influenza_CDR
augagcuuccugaccgagguggagacccccaucagaaacgaguggggcugcagaugcaacgacagcagcgac

SEQ ID NO: 38046 - RNA, 72 nt, Artificial Sequence
  derived and/or modified sequence opt4 from anti-influenza_CDR
augagccugcccaccgagguggagacccccaucagaagcgaguggggcugcagaugcaacgacagcagcgac

SEQ ID NO: 38047 - RNA, 72 nt, Artificial Sequence
  derived and/or modified sequence opt4 from anti-influenza_CDR
augagccugcugcccgagguggagacccccaucagaaacgaguggggcugcagaugcaacgacagcagcgac

SEQ ID NO: 38048 - RNA, 72 nt, Artificial Sequence
  derived and/or modified sequence opt4 from anti-influenza_CDR
augagccugcugcccgagguggagacccccaucagaaacggcuggggcugcagaugcaacgacagcagcgac

SEQ ID NO: 38049 - RNA, 72 nt, Artificial Sequence
  derived and/or modified sequence opt4 from anti-influenza_CDR
augagccugcugaccgagguggagacccccaccagaaacggcugggagugcagaugcagcggcagcagcgac

SEQ ID NO: 38050 - RNA, 72 nt, Artificial Sequence
  derived and/or modified sequence opt4 from anti-influenza_CDR
augagccugcugaccgagguggagacccccaucagaaacgagugggaguacagaugcaacgacagcagcgac

SEQ ID NO: 38051 - RNA, 72 nt, Artificial Sequence
  derived and/or modified sequence opt4 from anti-influenza_CDR
augagccugcugaccgagguggagacccccaucagaaacgagugggaguacagaugcagcgacagcagcgac

SEQ ID NO: 38052 - RNA, 72 nt, Artificial Sequence
  derived and/or modified sequence opt4 from anti-influenza_CDR
augagccugcugaccgagguggagacccccaccagaaacggcugggagugcagauacagcgacagcagcgac

SEQ ID NO: 38053 - RNA, 72 nt, Artificial Sequence
  derived and/or modified sequence opt4 from anti-influenza_CDR
augagcuuccugaccgagguggagacccugaccagaaacggcugggagugcagaugcagcgacagcagcgac

SEQ ID NO: 38054 - RNA, 72 nt, Artificial Sequence
  derived and/or modified sequence opt4 from anti-influenza_CDR
augagccugcugaccgagguggagacccugaccagaaacggcugggagugcaagugcagagacagcagcgac

SEQ ID NO: 38055 - RNA, 72 nt, Artificial Sequence
  derived and/or modified sequence opt4 from anti-influenza_CDR
augagccugcugaccgagguggagacccccaucagaaacgaguggggcugcagaugcaacgacagcagcgac

SEQ ID NO: 38056 - RNA, 72 nt, Artificial Sequence
  derived and/or modified sequence opt4 from anti-influenza_CDR
augagccugcugaccgagguggagacccccaucagaagcgaguggggcugcagaugcaacgacagcggcgac

SEQ ID NO: 38057 - RNA, 72 nt, Artificial Sequence
  derived and/or modified sequence opt4 from anti-influenza_CDR
augagccugcugaccgagguggagacccccaucagaaacgagugggagugcagaugcaacggcagcagcgac

SEQ ID NO: 38058 - RNA, 72 nt, Artificial Sequence
  derived and/or modified sequence opt4 from anti-influenza_CDR
augagccugcccaccgagguggagacccccaucagaaacgaguggggcugcagaugcaacgacagcagcgac

SEQ ID NO: 38059 - RNA, 72 nt, Artificial Sequence
  derived and/or modified sequence opt4 from anti-influenza_CDR
augagccugcugaccgagguggagacccccaucagaaacgaguggggcugcagaugcaacggcagcagcgac

SEQ ID NO: 38060 - RNA, 72 nt, Artificial Sequence
  derived and/or modified sequence opt4 from anti-influenza_CDR
augagccugcugaccgagguggacacccugaccagaaacggcuggggcugcagaugcagcgacagcagcgac

SEQ ID NO: 38061 - RNA, 72 nt, Artificial Sequence
  derived and/or modified sequence opt4 from anti-influenza_CDR
augagccugcugaccgagguggagacccugaccaagaacggcuggggcugcagaugcagcgacagcagcgac

SEQ ID NO: 38062 - RNA, 72 nt, Artificial Sequence
  derived and/or modified sequence opt4 from anti-influenza_CDR
augagccugcugaccgagguggagacccccaccagaaacggcugggagugcaagugcagcgacagcagcgac

SEQ ID NO: 38063 - RNA, 72 nt, Artificial Sequence
  derived and/or modified sequence opt4 from anti-influenza_CDR
augagccugcugaccgagguggagacccacaccagaaacggcugggagugcaagugcagcgacagcagcgac

SEQ ID NO: 38064 - RNA, 72 nt, Artificial Sequence
  derived and/or modified sequence opt4 from anti-influenza_CDR
augagccugcugaccgaggugaagacccccaccagaaacggcugggagugcaagugcagcgacagcagcgac

SEQ ID NO: 38065 - RNA, 72 nt, Artificial Sequence
  derived and/or modified sequence opt4 from anti-influenza_CDR
augagccugcugaccgagguggagacccugaccagaaacggcuggggcugcagaugcagcgacagcagcgac

SEQ ID NO: 38066 - RNA, 72 nt, Artificial Sequence
  derived and/or modified sequence opt4 from anti-influenza_CDR
augagccugcugaccgagguggagacccccaccagagacggcugggagugcaagugcagcgacagcagcgac

SEQ ID NO: 38067 - RNA, 72 nt, Artificial Sequence
  derived and/or modified sequence opt4 from anti-influenza_CDR
augagccugcugaccgagguggagacccccaccagaaacggcuggggcugcagaugcagcgacagcagcgac

SEQ ID NO: 38068 - RNA, 72 nt, Artificial Sequence
  derived and/or modified sequence opt4 from anti-influenza_CDR
augagccugcugaccgagguggagacccccaccagaaacggcugggagugcaagugcaacgacagcagcgac

SEQ ID NO: 38069 - RNA, 72 nt, Artificial Sequence
  derived and/or modified sequence opt4 from anti-influenza_CDR
augagccugcugaccgagguggagacccugaccagaaacggcugggagugcaagugcagcgacagcagcgac

SEQ ID NO: 38070 - RNA, 72 nt, Artificial Sequence
  derived and/or modified sequence opt4 from anti-influenza_CDR
augagccugcugaccgagguggagacccccaucagaaacgaguggggcugcaagugcaacgacagcagcgac

SEQ ID NO: 38071 - RNA, 72 nt, Artificial Sequence
  derived and/or modified sequence opt4 from anti-influenza_CDR
augagcuuccugaccgagguggagacccccaucagaaacgaguggggcugcagaugcaacggcagcagcgac

SEQ ID NO: 38072 - RNA, 72 nt, Artificial Sequence
  derived and/or modified sequence opt4 from anti-influenza_CDR
augagccugcugaccgagguggagacccccaccagaaacggcugggagugcagaugcaacgacagcagcgac

SEQ ID NO: 38073 - RNA, 72 nt, Artificial Sequence
  derived and/or modified sequence opt4 from anti-influenza_CDR
augagccugcugaccgagguggagacccccaucagaaagggcugggagugcaacugcagcgacagcagcgac

SEQ ID NO: 38074 - RNA, 72 nt, Artificial Sequence
  derived and/or modified sequence opt4 from anti-influenza_CDR
augagccugcugaccgagguggagacccccaccagaaacgagugggagugcagaugcagcgacagcagcgac

SEQ ID NO: 38075 - RNA, 72 nt, Artificial Sequence
  derived and/or modified sequence opt4 from anti-influenza_CDR
augagccugcugaccggcguggagacccacaccagaaacggcuggggcugcaagugcagcgacagcagcgac

SEQ ID NO: 38076 - RNA, 72 nt, Artificial Sequence
  derived and/or modified sequence opt4 from anti-influenza_CDR
augagccugcugcccgagguggagacccacaccagaaacggcuggggcugcagaugcagcgacagcagcgac

SEQ ID NO: 38077 - RNA, 72 nt, Artificial Sequence
  derived and/or modified sequence opt4 from anti-influenza_CDR
accgacggccccuacagcgacgacuucagaagcggcuacgccgccagauacagauacuucggcauggacgug

SEQ ID NO: 38078 - RNA, 75 nt, Artificial Sequence
  derived and/or modified sequence opt4 from anti-influenza_CDR
gccaagcacaugagccugcagcagguggugagcgccggcugggagagagccgaccuggugggcgacgccuucgac

SEQ ID NO: 38079 - RNA, 75 nt, Artificial Sequence
  derived and/or modified sequence opt4 from anti-influenza_CDR
gccaagcaccugagcaugcagcagguggugagcgccggcugggagagagccgaccuggugggcgacgccuucgac

SEQ ID NO: 38080 - RNA, 75 nt, Artificial Sequence
  derived and/or modified sequence opt4 from anti-influenza_CDR
gccaagcacgccagccugcagcagguggugagcgccggcugggagagagccgaccuggugggcgacgccuucgac

SEQ ID NO: 38081 - RNA, 75 nt, Artificial Sequence
  derived and/or modified sequence opt4 from anti-influenza_CDR
gccaagcacagcagccugcagcagguggugagcgccggcugggagagagccgaccuggugggcgacgccuucgac

SEQ ID NO: 38082 - RNA, 75 nt, Artificial Sequence
  derived and/or modified sequence opt4 from anti-influenza_CDR
gccaagcaccugagccugcagcagguggugagcgccggcugggagagagccgaccuggugggcgacgccuucgac

SEQ ID NO: 38083 - RNA, 75 nt, Artificial Sequence
  derived and/or modified sequence opt4 from anti-influenza_CDR
gccaagcacaugagcaugcagcagguggugagcgccggcugggagagagccgaccuggugggcgacgccuucgac

SEQ ID NO: 38084 - RNA, 75 nt, Artificial Sequence
  derived and/or modified sequence opt4 from anti-influenza_CDR
gccagaggccccgagaccuacuacuacgacaagaccaacuggcugaacagccaccccgacgaguacuuccagcac

SEQ ID NO: 38085 - RNA, 75 nt, Artificial Sequence
  derived and/or modified sequence opt4 from anti-influenza_CDR
accaccgacggccccuacagcgacgacuucagaagcggcuacgccgccagauacagauacuucggcauggacgug

SEQ ID NO: 38086 - RNA, 75 nt, Artificial Sequence
  derived and/or modified sequence opt4 from anti-influenza_CDR
accgacggccccuacagcgacgacuucagaagcggcuacgccgccagauacagauacuucggcauggacgugugg

SEQ ID NO: 38087 - RNA, 78 nt, Artificial Sequence
  derived and/or modified sequence opt4 from anti-influenza_CDR
gacauccagaugacccagagccccagcagccugagcgccagcgugggcgacagagugaccaucaccugcagaagcagc

SEQ ID NO: 38088 - RNA, 78 nt, Artificial Sequence
  derived and/or modified sequence opt4 from anti-influenza_CDR
gccaccggcagagccgccaccggcagcgccagcugcaccggcggcggcaccuacuggaccuacugcaccugcaccacc

SEQ ID NO: 38089 - RNA, 81 nt, Artificial Sequence
  derived and/or modified sequence opt4 from anti-influenza_CDR
ggcuacauccccgaggcccccagagacggccaggccuacgugagaaaggacggcgagugggugcugcugagcaccuuccug

SEQ ID NO: 38090 - RNA, 90 nt, Artificial Sequence
  derived and/or modified sequence opt4 from anti-influenza_CDR
caggugcagcugcuggagaccggcggcggccuggugaagcccggccagagccugaagcugagcugcgccgccagcggcuucaccuucacc

SEQ ID NO: 38091 - RNA, 96 nt, Artificial Sequence
  derived and/or modified sequence opt4 from anti-influenza_CDR
agauucaccaucagcagagacaacagcaagaacacccuguaccugcagaugaacagccugagagccgaggacaccgccguguacuacugcgccaag

SEQ ID NO: 38092 - RNA, 96 nt, Artificial Sequence
  derived and/or modified sequence opt4 from anti-influenza_CDR
ggcgugcccagcagauucagcggcagcggcagcggcaccgacuucacccugaccaucagcagccugcagcccgaggacuucgccaccuacuacugc

SEQ ID NO: 38093 - RNA, 15 nt, Artificial Sequence
  derived and/or modified sequence opt4 from anti-OX40_HeavyChain_CDR1
agcuacagcaugaac

SEQ ID NO: 38094 - RNA, 15 nt, Artificial Sequence
  derived and/or modified sequence opt4 from anti-OX40_HeavyChain_CDR1
gacuacgccaugcac

SEQ ID NO: 38095 - RNA, 15 nt, Artificial Sequence
  derived and/or modified sequence opt4 from anti-OX40_HeavyChain_CDR1
gacagcuacaugagc

SEQ ID NO: 38096 - RNA, 15 nt, Artificial Sequence
  derived and/or modified sequence opt4 from anti-OX40_HeavyChain_CDR1
gacgccuacaugagc

SEQ ID NO: 38097 - RNA, 15 nt, Artificial Sequence
  derived and/or modified sequence opt4 from anti-OX40_HeavyChain_CDR1
gagagcuacaugagc

SEQ ID NO: 38098 - RNA, 15 nt, Artificial Sequence
  derived and/or modified sequence opt4 from anti-OX40_HeavyChain_CDR1
agcggcuacuggaac

SEQ ID NO: 38099 - RNA, 21 nt, Artificial Sequence
  derived and/or modified sequence opt4 from anti-OX40_LightChain_CDR2
uacaccagcagacugcacagc

SEQ ID NO: 38100 - RNA, 21 nt, Artificial Sequence
  derived and/or modified sequence opt4 from anti-OX40_LightChain_CDR2
gccgccagcagccugcagagc

SEQ ID NO: 38101 - RNA, 21 nt, Artificial Sequence
  derived and/or modified sequence opt4 from anti-OX40_LightChain_CDR2
gacgccagcaacagagccacc

SEQ ID NO: 38102 - RNA, 21 nt, Artificial Sequence
  derived and/or modified sequence opt4 from anti-OX40_LightChain_CDR2
uacaccagcagacugagaagc

SEQ ID NO: 38103 - RNA, 24 nt, Artificial Sequence
  derived and/or modified sequence opt4 from anti-OX40_LightChain_CDR3
cagcagagaagcaacuggcccacc

SEQ ID NO: 38104 - RNA, 24 nt, Artificial Sequence
  derived and/or modified sequence opt4 from anti-OX40_HeavyChain_CDR3
gcccccagaugguacuucagcgug

SEQ ID NO: 38105 - RNA, 24 nt, Artificial Sequence
  derived and/or modified sequence opt4 from anti-OX40_HeavyChain_CDR3
gcccccagaugguacuucagcgcc

SEQ ID NO: 38106 - RNA, 24 nt, Artificial Sequence
  derived and/or modified sequence opt4 from anti-OX40_HeavyChain_CDR3
gcccccagaugguacuucgccgug

SEQ ID NO: 38107 - RNA, 27 nt, Artificial Sequence
  derived and/or modified sequence opt4 from anti-OX40_LightChain_CDR3
cagcagggcaacacccugcccuggacc

SEQ ID NO: 38108 - RNA, 27 nt, Artificial Sequence
  derived and/or modified sequence opt4 from anti-OX40_HeavyChain_CDR3
gagagcggcugguaccuguucgacuac

SEQ ID NO: 38109 - RNA, 27 nt, Artificial Sequence
  derived and/or modified sequence opt4 from anti-OX40_LightChain_CDR3
cagcaguacaacagcuacccccccacc

SEQ ID NO: 38110 - RNA, 27 nt, Artificial Sequence
  derived and/or modified sequence opt4 from anti-OX40_LightChain_CDR3
cagcagggccacacccugccccccacc

SEQ ID NO: 38111 - RNA, 27 nt, Artificial Sequence
  derived and/or modified sequence opt4 from anti-OX40_LightChain_CDR3
cagcagggccacacccugcccgccacc

SEQ ID NO: 38112 - RNA, 27 nt, Artificial Sequence
  derived and/or modified sequence opt4 from anti-OX40_LightChain_CDR3
cagcagggccacaccgccccccccacc

SEQ ID NO: 38113 - RNA, 27 nt, Artificial Sequence
  derived and/or modified sequence opt4 from anti-OX40_LightChain_CDR3
cagcagggcgccacccugccccccacc

SEQ ID NO: 38114 - RNA, 27 nt, Artificial Sequence
  derived and/or modified sequence opt4 from anti-OX40_LightChain_CDR3
cagcagggccacgcccugccccccacc

SEQ ID NO: 38115 - RNA, 27 nt, Artificial Sequence
  derived and/or modified sequence opt4 from anti-OX40_LightChain_CDR3
cagcaggcccacacccugccccccacc

SEQ ID NO: 38116 - RNA, 27 nt, Artificial Sequence
  derived and/or modified sequence opt4 from anti-OX40_LightChain_CDR3
cagcagggccacacccuggcccccacc

SEQ ID NO: 38117 - RNA, 27 nt, Artificial Sequence
  derived and/or modified sequence opt4 from anti-OX40_LightChain_CDR3
caggccggccacacccugccccccacc

SEQ ID NO: 38118 - RNA, 30 nt, Artificial Sequence; identical to SEQ ID NO: 15192
  derived and/or modified sequence opt4 from anti-OX40_HeavyChain_CDR1

SEQ ID NO: 38119 - RNA, 30 nt, Artificial Sequence
  derived and/or modified sequence opt4 from anti-OX40_HeavyChain_CDR3
uacuacggcagcagccugagcauggacuac

SEQ ID NO: 38120 - RNA, 33 nt, Artificial Sequence
  derived and/or modified sequence opt4 from anti-OX40_LightChain_CDR1
agagccagccaggacaucagcaacuaccugaac

SEQ ID NO: 38121 - RNA, 33 nt, Artificial Sequence
  derived and/or modified sequence opt4 from anti-OX40_LightChain_CDR1
agagccagccagggcaucagcagcuggcuggcc

SEQ ID NO: 38122 - RNA, 33 nt, Artificial Sequence; identical to SEQ ID NO: 37640
  derived and/or modified sequence opt4 from anti-OX40_LightChain_CDR1

SEQ ID NO: 38123 - RNA, 39 nt, Artificial Sequence
  derived and/or modified sequence opt4 from anti-OX40_HeavyChain_CDR3
uacagauacgacuacgacggcggccacgccauggacuac

SEQ ID NO: 38124 - RNA, 39 nt, Artificial Sequence; identical to SEQ ID NO: 15198
  derived and/or modified sequence opt4 from anti-OX40_HeavyChain_CDR3

SEQ ID NO: 38125 - RNA, 39 nt, Artificial Sequence; identical to SEQ ID NO: 22841
  derived and/or modified sequence opt4 from anti-OX40_HeavyChain_CDR3

SEQ ID NO: 38126 - RNA, 45 nt, Artificial Sequence; identical to SEQ ID NO: 15200
  derived and/or modified sequence opt4 from anti-OX40_HeavyChain_CDR3

SEQ ID NO: 38127 - RNA, 48 nt, Artificial Sequence
  derived and/or modified sequence opt4 from anti-OX40_HeavyChain_CDR2
uacaucagcuacaacggcaucaccuaccacaaccccagccugaagagc

SEQ ID NO: 38128 - RNA, 48 nt, Artificial Sequence
  derived and/or modified sequence opt4 from anti-OX40_HeavyChain_CDR2
uacaucagcuacaacgccaucaccuaccacaaccccagccugaagagc

SEQ ID NO: 38129 - RNA, 48 nt, Artificial Sequence
  derived and/or modified sequence opt4 from anti-OX40_HeavyChain_CDR2
uacaucagcuacagcggcaucaccuaccacaaccccagccugaagagc

SEQ ID NO: 38130 - RNA, 51 nt, Artificial Sequence; identical to SEQ ID NO: 22846
  derived and/or modified sequence opt4 from anti-OX40_HeavyChain_CDR2

SEQ ID NO: 38131 - RNA, 51 nt, Artificial Sequence
  derived and/or modified sequence opt4 from anti-OX40_HeavyChain_CDR2
uacaucagcagcagcagcagcaccaucgacuacgccgacagcgugaagggc

SEQ ID NO: 38132 - RNA, 51 nt, Artificial Sequence
  derived and/or modified sequence opt4 from anti-OX40_HeavyChain_CDR2
ggcaucagcuggaacagcggcagcaucggcuacgccgacagcgugaagggc

SEQ ID NO: 38133 - RNA, 51 nt, Artificial Sequence
  derived and/or modified sequence opt4 from anti-OX40_HeavyChain_CDR2
gacauguaccccgacaacggcgacagcagcuacaaccagaaguucagagag

SEQ ID NO: 38134 - RNA, 51 nt, Artificial Sequence
  derived and/or modified sequence opt4 from anti-OX40_HeavyChain_CDR2
gacauguaccccgacaacgccgacagcagcuacaaccagaaguucagagag

SEQ ID NO: 38135 - RNA, 51 nt, Artificial Sequence
  derived and/or modified sequence opt4 from anti-OX40_HeavyChain_CDR2
gacauguaccccgacaacgccgacgccagcuacaaccagaaguucagagag

SEQ ID NO: 38136 - RNA, 51 nt, Artificial Sequence
  derived and/or modified sequence opt4 from anti-OX40_HeavyChain_CDR2
gacauguaccccgacaacggcgacgccagcuacaaccagaaguucagagag

SEQ ID NO: 38137 - RNA, 51 nt, Artificial Sequence
  derived and/or modified sequence opt4 from anti-OX40_HeavyChain_CDR2
gacauguaccccgacagcggcgacagcagcuacaaccagaaguucagagag

SEQ ID NO: 38138 - RNA, 51 nt, Artificial Sequence
  derived and/or modified sequence opt4 from anti-OX40_HeavyChain_CDR2
gacauguaccccgacaacggcagcagcagcuacaaccagaaguucagagag

SEQ ID NO: 38139 - RNA, 309 nt, Artificial Sequence
  derived and/or modified sequence opt4 from Ig_LightChain_kappa_constant_domain
accguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacaga

SEQ ID NO: 38140 - RNA, 309 nt, Artificial Sequence
  derived and/or modified sequence opt4 from Ig_LightChain_kappa_constant_domain
accguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcaacacccugacccugagcaaggccgacuacgagaagcacaagguguacgccugcgaggugacccaccagggccugagcagccccgugaccaagagcuucaacaga

SEQ ID NO: 38141 - RNA, 312 nt, Artificial Sequence
  derived and/or modified sequence opt4 from Ig_LightChain_lambda_constant_domain
cccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 38142 - RNA, 312 nt, Artificial Sequence
  derived and/or modified sequence opt4 from Ig_LightChain_lambda_constant_domain
cccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccgccgagugcagc

SEQ ID NO: 38143 - RNA, 312 nt, Artificial Sequence
  derived and/or modified sequence opt4 from Ig_LightChain_lambda_constant_domain
cccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccaccgagugcagc

SEQ ID NO: 38144 - RNA, 312 nt, Artificial Sequence
  derived and/or modified sequence opt4 from Ig_LightChain_lambda_constant_domain
cccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccgccgagugcagc

SEQ ID NO: 38145 - RNA, 282 nt, Artificial Sequence
  derived and/or modified sequence opt4 from IgG1_HeavyChain_CH1_constant_domain
agcgccagcaccaagggccccagcguguucccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggug

SEQ ID NO: 38146 - RNA, 270 nt, Artificial Sequence
  derived and/or modified sequence opt4 from IgG1_HeavyChain_CH1_constant_domain
agcggccccagcguguucccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggug

SEQ ID NO: 38147 - RNA, 270 nt, Artificial Sequence
  derived and/or modified sequence opt4 from IgG1_HeavyChain_CH1_constant_domain
agcggccccagcguguucccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggcc

SEQ ID NO: 38148 - RNA, 270 nt, Artificial Sequence
  derived and/or modified sequence opt4 from IgG1_HeavyChain_CH1_constant_domain
agcggccccagcguguucccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagagug

SEQ ID NO: 38149 - RNA, 270 nt, Artificial Sequence
  derived and/or modified sequence opt4 from IgG1_HeavyChain_CH1_constant_domain
agcggccccagcguguucccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagagcc

SEQ ID NO: 38150 - RNA, 270 nt, Artificial Sequence
  derived and/or modified sequence opt4 from IgG1_HeavyChain_CH1_constant_domain
agcggccccagcgugcugccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggug

SEQ ID NO: 38151 - RNA, 270 nt, Artificial Sequence
  derived and/or modified sequence opt4 from IgG1_HeavyChain_CH1_constant_domain
agcggccccagcgugcugccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggcc

SEQ ID NO: 38152 - RNA, 270 nt, Artificial Sequence
  derived and/or modified sequence opt4 from IgG1_HeavyChain_CH1_constant_domain
agcggccccagcgugcugccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagagug

SEQ ID NO: 38153 - RNA, 270 nt, Artificial Sequence
  derived and/or modified sequence opt4 from IgG1_HeavyChain_CH1_constant_domain
agcggccccagcgugcugccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagagcc

SEQ ID NO: 38154 - RNA, 282 nt, Artificial Sequence
  derived and/or modified sequence opt4 from IgG1_HeavyChain_CH1_constant_domain
agcgccagcaccaagggccccagcguguucccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggcc

SEQ ID NO: 38155 - RNA, 282 nt, Artificial Sequence
  derived and/or modified sequence opt4 from IgG1_HeavyChain_CH1_constant_domain
agcgccagcaccaagggccccagcguguucccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagagug

SEQ ID NO: 38156 - RNA, 282 nt, Artificial Sequence
  derived and/or modified sequence opt4 from IgG1_HeavyChain_CH1_constant_domain
agcgccagcaccaagggccccagcguguucccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagagcc

SEQ ID NO: 38157 - RNA, 282 nt, Artificial Sequence
  derived and/or modified sequence opt4 from IgG1_HeavyChain_CH1_constant_domain
agcgccagcaccaagggccccagcgugcugccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggug

SEQ ID NO: 38158 - RNA, 282 nt, Artificial Sequence
  derived and/or modified sequence opt4 from IgG1_HeavyChain_CH1_constant_domain
agcgccagcaccaagggccccagcgugcugccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggcc

SEQ ID NO: 38159 - RNA, 282 nt, Artificial Sequence
  derived and/or modified sequence opt4 from IgG1_HeavyChain_CH1_constant_domain
agcgccagcaccaagggccccagcgugcugccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagagug

SEQ ID NO: 38160 - RNA, 282 nt, Artificial Sequence
  derived and/or modified sequence opt4 from IgG1_HeavyChain_CH1_constant_domain
agcgccagcaccaagggccccagcgugcugccccuggcccccagcagcaagagcaccagcggcggcaccgccgcccugggcugccuggugaaggacuacuuccccgagcccgugaccgugagcuggaacagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagagcc

SEQ ID NO: 38161 - RNA, 330 nt, Artificial Sequence
  derived and/or modified sequence opt4 from IgG1_HeavyChain_CH2_constant_domain
gcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaag
